US012692472B2

(12) United States Patent
Mally et al.

(10) Patent No.: US 12,692,472 B2
(45) Date of Patent: Jul. 28, 2026

(54) **GLYCOENGINEERING USING *LEISHMANIA* CELLS**

(71) Applicant: LIMMATECH BIOLOGICS AG, Schlieren (CH)

(72) Inventors: Manuela Mally, Schlieren (CH); Amirreza Faridmoayer, Schlieren (CH); Rainer Follador, Schlieren (CH); Anke Judith Harsman, Schlieren (CH)

(73) Assignee: LIMMATECH BIOLOGICS AG, Schlieren (CH)

( * ) Notice: Subject to any disclaimer, the term of this patent is extended or adjusted under 35 U.S.C. 154(b) by 854 days.

(21) Appl. No.: 17/791,011

(22) PCT Filed: Jan. 7, 2021

(86) PCT No.: PCT/EP2021/050172

§ 371 (c)(1),
(2) Date: Jul. 6, 2022

(87) PCT Pub. No.: WO2021/140143

PCT Pub. Date: Jul. 15, 2021

(65) Prior Publication Data

US 2023/0287327 A1 Sep. 14, 2023

Related U.S. Application Data

(60) Provisional application No. 62/958,070, filed on Jan. 7, 2020.

(51) Int. Cl.

| | |
|---|---|
| ***C12N 1/10*** | (2026.01) |
| ***C12N 9/10*** | (2006.01) |
| ***C12P 21/00*** | (2006.01) |

(52) U.S. Cl.

CPC ............ *C12N 1/10* (2013.01); *C12N 9/1048* (2013.01); *C12P 21/005* (2013.01)

(58) Field of Classification Search

CPC ........ C12N 1/10; C12N 9/1048; C12P 21/005

See application file for complete search history.

(56) References Cited

U.S. PATENT DOCUMENTS

| | | | |
|---|---|---|---|
| 5,714,377 | A | 2/1998 | Tanner |
| 11,236,136 | B2 | 2/2022 | Wetter et al. |

(Continued)

FOREIGN PATENT DOCUMENTS

| | | |
|---|---|---|
| CA | 2388151 | 5/2001 |
| WO | WO 2002/090556 | 11/2002 |

(Continued)

OTHER PUBLICATIONS

Alsford et al., 2011, "High-throughput phenotyping using parallel sequencing of RNA interference targets in the African trypanosome," Genome Research, 21(6):915-924.

(Continued)

*Primary Examiner* — David W Berke-Schlessel
*Assistant Examiner* — Trent R Clarke
(74) *Attorney, Agent, or Firm* — Jones Day

(57) ABSTRACT

The present application relates to *Leishmania* cells genetically engineered such that the formation of an O-linked GlcNAc on a polypeptide in the *Leishmania* cell is reduced or eliminated. The formation of the O-linked GlcNAc may be catalyzed in the *Leishmania* cell prior to said genetic engineering by at least one N-acetylglucosamine (GlcNAc)-transferase. Also provided herein are methods of making a polypeptide using a *Leishmania* cell described herein and polypeptides produced by the methods provided herein.

20 Claims, 30 Drawing Sheets

Figure 1:
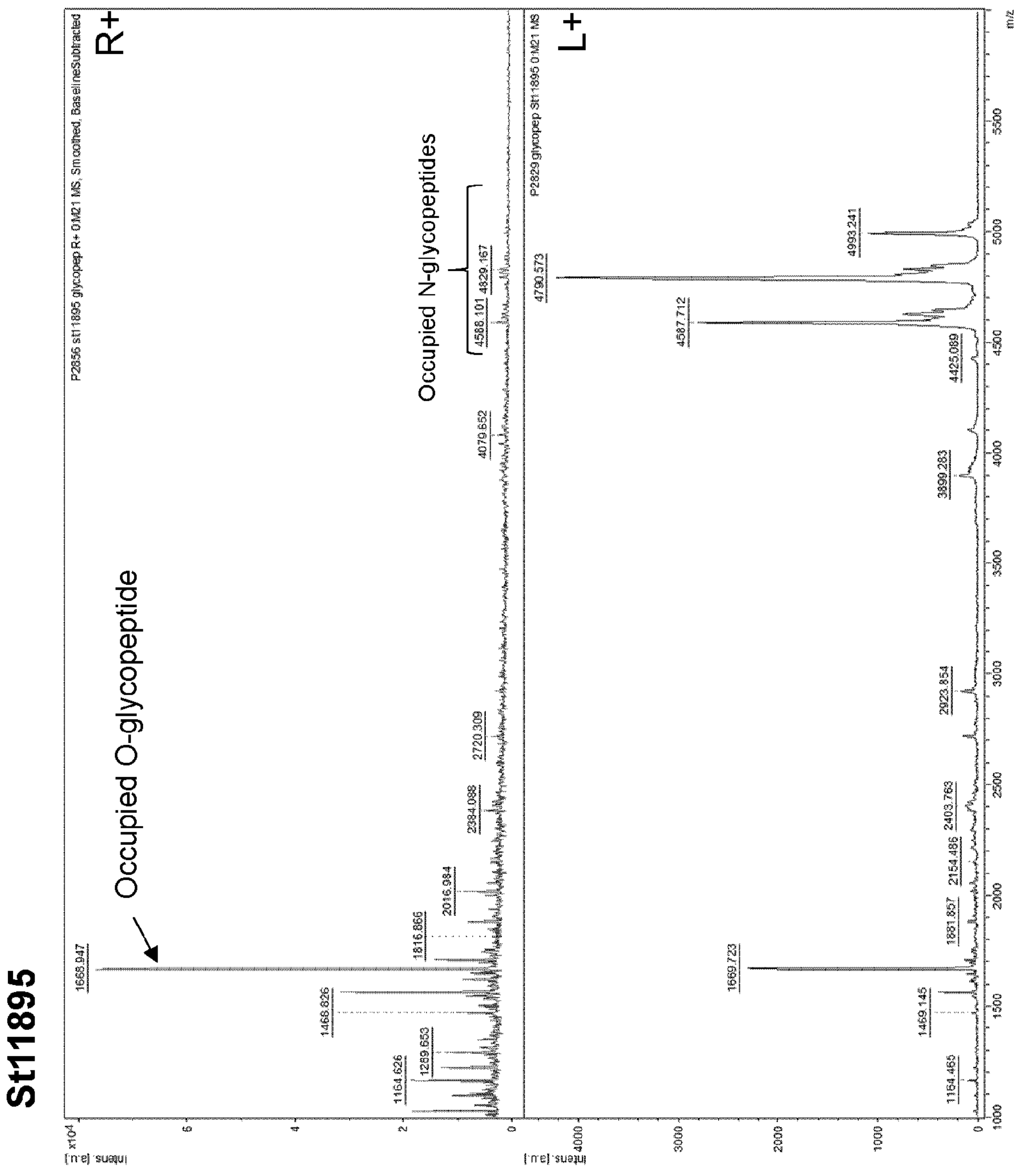

Specification includes a Sequence Listing.

(56) References Cited

U.S. PATENT DOCUMENTS

| | | | | |
|---|---|---|---|---|
| 2004/0229229 | A1 | 11/2004 | Cheo et al. | |
| 2006/0286637 | A1 | 12/2006 | Hamilton | |
| 2010/0009866 | A1* | 1/2010 | Prinz | C12N 15/1034 506/9 |
| 2016/0289290 | A1* | 10/2016 | Meehl | C07K 14/62 |
| 2018/0354997 | A1 | 12/2018 | Wetter et al. | |
| 2021/0332403 | A1 | 10/2021 | Faridmoayer et al. | |
| 2022/0242919 | A1 | 8/2022 | Wetter et al. | |

FOREIGN PATENT DOCUMENTS

| | | |
|---|---|---|
| WO | WO 2007/061631 A2 | 5/2007 |
| WO | WO 2007/130638 | 11/2007 |
| WO | WO 2014/099632 | 6/2014 |
| WO | WO 2016/091268 | 6/2016 |
| WO | WO 2017/093291 | 6/2017 |
| WO | WO 2019/002512 | 1/2019 |
| WO | WO 2019/234021 | 12/2019 |
| WO | WO 2021/140143 | 7/2021 |
| WO | WO 2021/140144 | 7/2021 |

OTHER PUBLICATIONS

Basile et al., 2009, "Recombinant Protein Expression in Leishmania tarentolae," Molecular Biotechnology, 43(3):273-278.

Behrens et al., 2018, "Glycosylation profiling of dog serum reveals differences compared to human serum," Glycobiology, 28(11):825-831.

Beneke et al., 2017, "A CRISPR Cas9 high-throughput genome editing toolkit for kinetoplastids," Royal Society Open Science, 4(5):170095.

Bennett et al., 2012, "Control of mucin-type O-glycosylation: a classification of the polypeptide GalNAc-transferase gene family," Glycobiology, 22(6):736-756.

Berlec and Štrukelj, 2013, "Current state and recent advances in biopharmaceutical production in *Escherichia coli*, yeasts and mammalian cells," Journal of Industrial Microbiology and Biotechnology, 40(3-4):257-274.

Beverley, S, 1991, "Gene amplification in Leishmania," Annual Review of Microbiology, 45:417-444.

Boucher et al., 2002, "RNA polymerase I-mediated transcription of a reporter gene integrated into different loci of Leishmania, " Molecular & Biochemical Parasitology, 119(1):153-158.

Boucher et al., 2004, "The ribosomal RNA gene promoter and adjacent cis-acting DNA sequences govern plasmid DNA partitioning and stable inheritance in the parasitic protozoan Leishmania," Nucleic Acids Research, 32(9):2925-2936.

Breitling et al, 2002, "Non-pathogenic trypanosomatid protozoa as a platform for protein research and production," Protein Expression and Purification, 25(2):209-218.

Camacho et al., 2009, "BLAST+: architecture and applications," BMC Bioinformatics, 10:421.

Carrilo et al., 2000, "Heterologous Expression of Trypanosoma cruzi trans-Sialidase in Leishmania major Enhances Virulence," Infection and Immunity, 68(5):2728-2734.

Carver et al., 2005, "ACT: the Artemis Comparison Tool," Bioinformatics, 21(16):3422-3423.

Choi et al., 2012, "Improvement of N-glycan site occupancy of therapeutic glycoproteins produced in Pichia pastoris," Applied Microbiology and Biotechnology, 95(3):671-682.

Cong et al., 2013, "Multiplex genome engineering using CRISPR/Cas systems," Science, 339(6121):819-823.

Cox et al, 2006, "Glycan optimization of a human monoclonal antibody in the aquatic plant Lemna minor," Nature Biotechnology, 24(12):1591-1597.

Czlapinski et al, 2006, "Synthetic glycobiology: Exploits in the Golgi compartment," Current Opinion in Chemical Biology, 10(6):645-651.

Duncan et al., 2017, "Recent advances in Leishmania reverse genetics: Manipulating a manipulative parasite," Molecular and Biochemical Parasitology, 216:30-38.

Fernandez-Prada et al., 2018, "High-throughput Cos-Seq screen with intracellular Leishmania infantum for the discovery of novel drug-resistance mechanisms," International Journal for Parasitology: Drugs and Drug Resistance, 8(2):165-173.

Fulwiler et al., 2011, "A rapid, efficient and economical method for generating leishmanial gene targeting constructs," Molecular and Biochemical Parasitology, 175(2):209-212.

Galuska et al., 2010, "Quantification of nucleotide-activated sialic acids by a combination of reduction and fluorescent labeling," Analytical Chemistry, 82(11):4591-4598.

Geisler et al., 2015, "Engineering β1,4-galactosyltransferase I to reduce secretion and enhance N-glycan elongation in insect cells," Journal of Biotechnology, 193:52-65.

Grabenhorst et al., 1999, "The Cytoplasmic, Transmembrane, and Stem Regions of Glycosyltransferases Specify Their in Vivo Functional Sublocalization and Stability in the Golgi," Journal of Biological Chemistry, 274(51):36107-36116.

Gu et al., 2015, "A rapid and reliable strategy for chromosomal integration of gene(s) with multiple copies," Scientific Reports, 5:9684.

Gupta and Musunuru, 2014, "Expanding the genetic editing tool kit: ZFNs, TALENs, and CRISPR-Cas9," The Journal of Clinical Investigation, 124(10):4154- 4161.

Hagen et al., 2003, "All in the family: the UDP-GalNAc:polypeptide N-acetylgalactosaminyltransferases," Glycobiology, 13(1):1R-16R.

Halim et al., 2014, "Assignment of saccharide identities through analysis of oxonium ion fragmentation profiles in LC-MS/MS of glycopeptides," Journal of Proteome Research, 13(12):6024-6032.

Hashii et al., 2019, "In-depth site-specific O-Glycosylation analysis of therapeutic Fc-fusion protein by electron-transfer/higher-energy collisional dissociation mass spectrometry," Biologicals, 58:35-43.

Heise et al., 2009, "Molecular analysis of a UDP-GlcNAc:polypeptide alpha-N-acetylglucosaminyltransferase implicated in the initiation of mucin-type O-glycosylation in Trypanosoma cruzi," Glycobiology, 19(8):918-933.

International Search Report and Written Opinion dated Jan. 30, 2019 for PCT/EP2018/067494 (22 pages).

International Search Report and Written Opinion dated Apr. 20, 2021 for PCT/EP2021/050172 (15 pages).

International Seach Report and Written Opinion dated May 10, 2021 for PCT/EP2021/050173 (15 pages).

Ishemgulova et al., 2018, "CRISPR/Cas9 in Leishmania mexicana: a case study of LmxBTN1," PLoS One, 13(2):e0192723.

Joshi et al., 2018, "SnapShot: O-Glycosylation Pathways across Kingdoms," Cell, 172(3):632.

Kasajima et al., 2006, "In Vivo Expression of UDP-N-Acetylglucosamine: α-3-D-Mannoside β-1,2-N-Acetylglucosaminyltransferase I (GnT-1) in Aspergillus oryzae and Effects on the Sugar Chain of α-Amylase," Bioscience, Biotechnology, and Biochemistry, 70(11):2662-2668.

Khan et al., 2017, "Humanizing glycosylation pathways in eukaryotic expression systems," World Journal of Microbiology and Biotechnology, 33(1):4.

Klatt et al., 2013, "Production of Glycosylated Soluble Amyloid Precursor Protein Alpha (sAPPalpha) in Leishmania tarentolae," Journal of Proteome Research, 12(1):396-403.

Koren et al., 2017, "Canu: scalable and accurate long-read assembly via adaptive k-mer weighting and repeat separation," Genome Research, 27(5):722-736.

Kurogochi et al, 2015, "Glycoengineered Monoclonal Antibodies with Homogeneous Glycan (M3, G0, G2, and A2) Using a Chemoenzymatic Approach Have Different Affinities for FcγRIIIa and Variable Antibody-Dependent Cellular Cytotoxicity Activities," PLoS One, 10(7):e0132848.

Las Rivas et al., 2019, "Polypeptide GalNAc-Ts: from redundancy to specificity," Current Opinion in Structural Biology, 56:87-96.

Li, H, 2013, "Aligning sequence reads, clone sequences and assembly contigs with BWA-MEM," Broad Institute of Harvard and MIT, http://arxiv.org/pdf/1303.3997v2.

(56) References Cited

OTHER PUBLICATIONS

Li and Godzik, 2006, "Cd-hit: a fast program for clustering and comparing large sets of protein or nucleotide sequences," Bioinformatics, 22(13):1658-1659.
Li et al., 2019, "Synthesis and biological roles of O-glycans in insects," Glycoconjugate Journal, 37:47-56.
Lodes et al., 1995, "Increased expression of LD1 genes transcribed by RNA polymerase I in Leishmania donovani as a result of duplication into the rRNA gene locus," Molecular and Cellular Biology, 15(12):6845-6853.
Lye et al., 2010, "Retention and Loss of RNA Interference Pathways in Trypanosomatid Protozoans," PLoS Pathogens, 6(10):e1001161.
Montesino et al, 2012, "Structural characterization of N-linked oligosaccharides on monoclonal antibody Nimotuzumab through process development," Biologicals, 40(4):288-298.
Mukherjee et al., 2009, "The gamma-glutamylcysteine synthetase gene of *Leishmania* is essential and involved in response to oxidants," Molecular Microbiology, 74(4):914-927.
Murray et al., 2007, "Regions in the 3' untranslated region confer stage-specific expression to the Leishmania mexicana a600-4 gene," Molecular and Biochemical Parasitology, 153(2):125-132.
Parsons et al., 2013, "A gene responsible for prolyl-hydroxylation of moss-produced recombinant human erythropoietin," Scientific Reports, 3:3019.
Peng et al., 2015, "CRISPR-Cas9-Mediated Single-Gene and Gene Family Disruption in *Trypanosoma cruzi*," mBio, 6(1):e02097.
Plomp et al., 2015, "Hinge-Region O-Glycosylation of Human Immunoglobulin G3 (IgG3)," Molecular & Cellular Proteomics, 14(5):1373-1384.
Previato et al., 1998, "Biosynthesis of O-N-acetylglucosamine-linked glycans in Trypanosoma cruzi. Characterization of the novel uridine diphospho-N-acetylglucosamine:polypeptide N-acetylglucosaminyltransferase-catalyzing formation of N-acetylglucosamine alpha1—>O-threonine," Journal of Biological Chemistry, 273(24): 14982-14988.
Rastrojo et al., 2013, "The transcriptome of Leishmania major in the axenic promastigote stage: transcript annotation and relative expression levels by RNA-seq," BMC Genomics, 14:223.
Raymond et al., 2012, "Genome sequencing of the lizard parasite Leishmania tarentolae reveals loss of genes associated to the intracellular stage of human pathogenic species," Nucleic Acids Research, 40(3):1131-1147.
Rice et al.. 2000, "EMBOSS: the European Molecular Biology Open Software Suite," Trends in Genetics, 16(6):276-277.
Roberts, S, 2011, "The genetic toolbox for Leishmania parasites," Bioengineered Bugs, 2(6):320-326.
Roper et al., 2002, "Galactose metabolism is essential for the African sleeping sickness parasite *Trypanosoma brucei*," Proceedings of the National Academy of Sciences (PNAS), 99(9):5884-5889.
Sansom et al., 2014, "Golgi-Located NTPDasel of Leishmania major Is Required for Lipophosphoglycan Elongation and Normal Lesion Development whereas Secreted NTPDase2 Is Dispensable for Virulence," PLOS Neglected Tropical Diseases, 8(12):e3402.
Schoberer and Strasser, 2018, "Plant glyco-biotechnology," Seminars in Cell & Developmental Biology, 80:133-141.
Shao et al., 2009, "DNA assembler, an in vivo genetic method for rapid construction of biochemical pathways," Nucleic Acids Research, 37(2):e16.
Spahr et al., 2014, "O-Glycosylation of glycine-serine linkers in recombinant Fc-fusion proteins," mAbs, 6(4):904-914.
Spahr et al., 2013, "Recombinant human lecithin-cholesterol acyltransferase Fc fusion: Analysis of N- and O-linked glycans and identification and elimination of a xylose-based O-linked tetrasaccharide core in the linker region," Protein Science, 22(12):1739-1753.
Späth et al., 2000, "Lipophosphoglycan is a virulence factor distinct from related glycoconjugates in the protozoan parasite Leishmania major," Proceedings of the National Academy of Sciences (PNAS), 97(16):9258-9263.
Stavenhagen et al., 2019, "Site-specific N- and O-glycosylation analysis of atacicept," mAbs, 11(6):1053-1063.
Vanbleu et al., 2004, "Genetic and Physical Map of the pLAFRI Vector," DNA Sequence, 15(3):225-227.
Wen et al., 2013, "Discovery and Investigation of O-Xylosylation in Engineered Proteins Containing a (GGGGS)n Linker," Analytical Chemistry, 85(9):4805-4812.
Zhang and Matlashewski, 2015, "CRISPR-Cas9-Mediated Genome Editing in Leishmania donovani," mBio, 6(4):e00861.
Zhang and Matlashewski, 2019, "Single-Strand Annealing Plays a Major Role in Double-Strand DNA Break Repair following CRISPR-Cas9 Cleavage in Leishmania," mSphere, 4(4):e00408.
Zhang et al., 2017, "Optimized CRISPR-Cas9 Genome Editing for Leishmania and Its Use to Target a Multigene Family, Induce Chromosomal Translocation, and Study DNA Break Repair Mechanisms," mSphere, 2(1):e00340-16.
Zhong et al., 2013, "Pyroglutamate and O-Linked Glycan Determine Functional Production of Anti-IL17A and Anti-IL22 Peptide-Antibody Bispecific Genetic Fusions," Journal of Biological Chemistry, 288(2):1409-1419.
Zomerdijk et al., 1992, "A ribosomal RNA gene promoter at the telomere of a mini-chromosome in Trypanosoma brucei," Nucleic Acids Research, 20(11):2725-2734.
Girrbach et al., 2003, "Members of the evolutionarily conserved PMT family of protein O-mannosyltransferases form distinct protein complexes among themselves," J Biol Chem. 278(14):12554-62 (9 pages).
Mule et al., 2020, "Protein glycosylation in *Leishmania* spp," Mol Omics. 16(5):407-424 (18 pages).

* cited by examiner

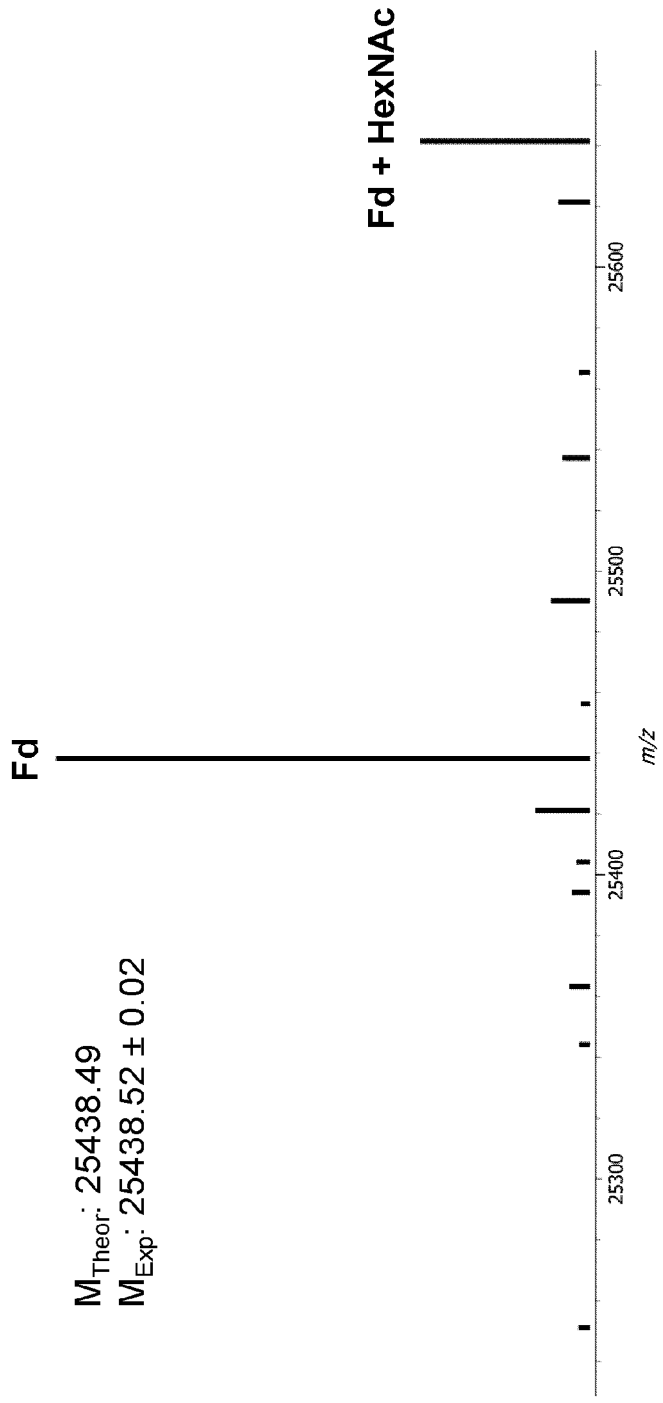
FIG. 2C (Subunit / IdeS)

GLYCOENGINEERING USING *LEISHMANIA* CELLS

This application is a U.S. National Stage Application of International Patent Application No. PCT/EP2021/050172, filed Jan. 7, 2021, which claims priority to U.S. Provisional Application No. 62/958,070, filed on Jan. 7, 2020, the content of each of which is incorporated herein by reference in its entirety.

SEQUENCE LISTING

This application incorporates by reference in its entirety the Computer Readable Form (CRF) of a Sequence Listing in ASCII text format. The Sequence Listing text file is entitled "14197-010-228_SEQ_LISTING," was created on Dec. 23, 2020, and is 1,350,529 bytes in size.

1. INTRODUCTION

The present application relates to *Leishmania* cells genetically engineered such that the formation of an O-linked GlcNAc on a polypeptide in the *Leishmania* cell is reduced or eliminated. The formation of the O-linked GlcNAc may be catalyzed in the *Leishmania* cell prior to said genetic engineering by at least one N-acetylglucosamine (GlcNAc)-transferase. Also provided herein are methods of making a polypeptide using a *Leishmania* cell described herein and polypeptides produced by the methods provided herein.

2. BACKGROUND

A glycoprotein is a glycoconjugate in which a protein carries one or more glycans covalently attached to a polypeptide backbone, usually via N- or O-linkages. An N-glycan (N-linked oligosaccharide, N-[Asn]-linked oligosaccharide) is a sugar chain covalently linked to an asparagine residue of a polypeptide chain, commonly involving a GlcNAc residue in eukaryotes, and the consensus peptide sequence: Asn-X-Ser/Thr (Varki, Ajit (2009): Essentials of glycobiology. 2ed. Cold Spring Harbor, N.Y.: Cold Spring Harbor Laboratory Press).

O-glycosylation is one of the most abundant and diverse types of post-translational modifications of proteins. O-glycans modulate the structure, stability, and function of proteins and serve generalized as well as highly specific roles in most biological processes. In eukaryotes, all types of O-glycosylation are initiated by distinct polypeptide glycosyltransferases, and most glycans are further elongated/branched and capped in the Golgi by sequential addition of monosaccharides directed by distinct and/or common enzymes. An O-glycan (O-linked oligosaccharide) in vertebrates is frequently linked to the polypeptide via N-acetylgalactosamine (GalNAc) to a hydroxyl group of a serine or threonine residue and can be extended into different structural core classes (Joshi, Hiren J et al (2018) Cell 172 (3), 632-632.e2).

Mucin-type O-glycosylation is a post-translational modification (PTM) that is predicted to occur in more than the 80% of the proteins that pass through the Golgi apparatus. This PTM is initiated by a family of polypeptide GalNAc-transferases (GalNAc-Ts) that modify Ser and Thr residues of proteins through the addition of a GalNAc moiety (Las Rivas, et al. (2019) In *Current opinion in structural biology* 56, pp. 87-96). A mucin is a large glycoprotein that carries many O-glycans that are clustered (closely spaced). Several other types of O-glycans also exist (e.g., O-linked fucose, glucose, or mannose) (Varki, Ajit (2009): Essentials of glycobiology. 2. ed. Cold Spring Harbor, N.Y.: Cold Spring Harbor Laboratory Press; Varki, Ajit, et al. (Eds.) (2015): Essentials of Glycobiology. Cold Spring Harbor Laboratory Press. 3rd. Cold Spring Harbor (NY)).

O-glycosylation is a frequent posttranslational modification but its control in the expression of therapeutic biologics has been challenging. Knockout of glycosylation genes to eliminate unwanted glycans has long been in the strategy to achieve clean expression hosts (Varki, Ajit, et al. (Eds.) (2015): Essentials of Glycobiology. Cold Spring Harbor Laboratory Press. 3rd. Cold Spring Harbor (NY)).

But engineering O-GalNAc glycans is challenging because up to 20 polypeptide GalNAc-transferases may synthesize O-GalNAc glycans. The result is that a protein that is naturally found with an O-glycan may not be O-glycosylated when expressed in a specific production cell line, and vice versa (Varki, Ajit, et al. (Eds.) (2015): Essentials of Glycobiology. Cold Spring Harbor Laboratory Press. 3rd. Cold Spring Harbor (NY)). Several examples show the problem:

Expression of human O-glycoproteins in yeast may result in O-mannosylation at sites that carry O-GalNAc in mammals. Examples of this include the hinge region of Ig and mucin sequences (Varki, Ajit, et al. (Eds.) (2015): Essentials of Glycobiology. Cold Spring Harbor Laboratory Press. 3rd. Cold Spring Harbor (NY)). In general, yeasts and fungi will exclusively perform O-mannosylation. Furthermore, yeast-type O-glycans are structurally different from human-type O-glycans, introducing concerns about the immunogenicity of O-glycosylated biopharmaceuticals produced by yeast. To address these problems, probably the most efficient manner is to change the sequence of the protein to avoid yeast-type O-glycans altogether. However, as the consensus sequence is rather unpredictable, this strategy depends on the ability to experimentally determine the sites of O-glycosylation, a less than trivial task. As yeast need O-glycosylated proteins to maintain their cell wall integrity and fitness, deletion mutants have proven not to be the solution to the problem (Wachter, Charlot de; et al. (2018) Advances in biochemical engineering/biotechnology. DOI: 10.1007/10_2018_69).

Plants do not have the types of O-glycosylation found in other eukaryotes, but produce unique O-glycans. O-glycosylation of plants and mammals is fundamentally different. In plants, serine residues from extensins and other members of the hydroxyproline-rich glyco-protein family can be glycosylated with a single galactose (Schoberer, Jennifer, Strasser, Richard (2017) Seminars in cell & developmental biology. DOI: 10.1016/j.semcdb.2017.07.005). In plants, the main anchor for O-glycosylation is 4-trans-hydroxyproline (Hyp). Indeed, undesired plant-typical prolyl-hydroxylation and in some cases subsequent arabinosylation of biopharmaceuticals was reported. Non-human prolyl-hydroxylation does not only alter the native sequence of the protein, but also serves as anchor for O-glycans, which in turn may be immunogenic. Plant-derived rhEPO from moss and *Nicotiana benthamiana* was shown to be hydroxylated within the motif SPP (amino acids 147-149). A targeted knockout of P4H1, the gene for non-human prolyl-hydroxylation of human erythropoietin recombinantly produced in *Physcomitrella patens*, eliminated the attachment of plant specific O-glycosylation on rhEPO (Parsons, Juliana; et al. (2013) Scientific reports 3, p. 3019. DOI: 10.1038/srep03019). Although a number of the glycosyltransferases have been knocked out in different plants, no completely clean O-glycosylation free plant system has been achieved. And only if issues related to hydroxyproline can be resolved, plants would offer a suitable system in which different types of mammalian O-glycosylation can be engineered and exploited. It is unclear whether these modifications can be completely eliminated without affecting viability (Varki, Ajit, et al. (Eds.) (2015): Essentials of Glycobiology. Cold Spring Harbor Laboratory Press. 3rd. Cold Spring Harbor (NY)).

Insect cells perform similar range of O-glycosylation as mammalian cells, although the extent to which O-GalNAc glycans are attached at the same sites as in mammals is unexplored. Moreover, the degree of processing of O-glycans appears incomplete, at least using baculovirus expression (Varki, Ajit, et al. (Eds.) (2015): Essentials of Glycobiology. Cold Spring Harbor Laboratory Press. 3rd. Cold Spring Harbor (NY)). O-glycans with a GalNAc directly attached to the amino acid are referred to as mucin type O-glycans and are the most prevalent O-glycans in *Drosophila* embryos, constituting about 90% of total O-glycan profile (Li, Weidong, et al. (2019) Glycoconjugate journal. DOI: 10.1007/s10719-019-09867-1).

Mammalian cells perform many different types of O-glycosylation, and these exert diverse and important biological functions. Recombinant coagulation factors in clinical use carry O-GalNAc, O-Fuc, and/or O-Glc glycans, and many other approved drugs including erythropoietin and Enbrel have O-GalNAc type glycans (Varki, Ajit, et al. (Eds.) (2015): Essentials of Glycobiology. Cold Spring Harbor Laboratory Press. 3rd. Cold Spring Harbor (NY)).

Importantly, recent reports along with the development of high-end analytical tools point out the observations of diverse unwanted and/or elevated O-glycosylation in therapeutic proteins, some of them already approved (Hashii et al. (2019) Biologicals: journal of the International Association of Biological Standardization. DOI: 10.1016/j.biologicals.2019.01.005; Plomp et al. (2015) Mol Cell Proteomics 14 (5), pp. 1373-1384; Berlec and Strukelj (2013) J Ind Microbiol Biotechnol 40 (3-4), pp. 257-274.; Spahr, et al. (2013) Protein science: a publication of the Protein Society 22 (12), pp. 1739-1753. DOI: 10.1002/pro.2373; Spahr, et al (2014) mAbs 6 (4), pp. 904-914; Stavenhagen et al. (2019) mAbs 11 (6), pp. 1053-1063; Wen, et al (2013) Analytical chemistry 85 (9), pp. 4805-4812; Zhong, et al. (2013) The Journal Of Biological Chemistry 288 (2), pp. 1409-1419).

Provided in this application is a recombinant expression host that allows controlling O-glycosylation. The strategy is based on CustomGlycan *Leishmania* cell lines that are not capable of O-glycosylating proteins due to deletion of the native polypeptide GlcNAc-transferases while remaining fit and not suffering from any other phenotypic impact observed with other species. The technology provides a solution to express therapeutic proteins that should not be O-glycosylated, as undesired O-glycosylation in recombinantly expressed proteins appears to be a challenge in many cases. Modification control further increases product homogeneity and ensures product consistency and consequently leads to less risk of unwanted immune reactions when delivered to subjects.

The application describes O-glycosylation deficient *Leishmania* host cells for producing consistent therapeutic protein modalities where the absence of O-glycosylation is required and further avoids unwanted O-glycosylation of susceptible protein regions. O-glycosylation was identified and characterized as O-GlcNAc. This also provides the outlook of attaching relevant glycans onto O-GlcNAc in *Leishmania* host cells within the CustomGlycan Platform (International Publication No. WO2019/002512 A2, incorporated by reference in its entirety herein).

3. SUMMARY OF THE INVENTION

Provided herein are *Leishmania* cells, methods of making a polypeptide using a *Leishmania* cell, and polypeptides produced by the methods.

In one aspect, provided herein is a *Leishmania* cell genetically engineered such that the formation of an O-linked GlcNAc on a polypeptide in the *Leishmania* cell is reduced or eliminated.

In certain embodiments, the formation of O-linked GlcNAc in the *Leishmania* cell prior to genetic engineering is catalyzed by at least one N-acetylglucosamine (GlcNAc)-transferase.

In certain embodiments, the gene encoding the at least one GlcNAc-transferase is functionally inactivated. In certain embodiments, the gene encoding the at least one GlcNAc-transferase is downregulated. In certain embodiments, the gene encoding the at least one GlcNAc-transferase is deleted or mutated. In certain embodiments, the gene encoding the at least one GlcNAc-transferase is overexpressed.

In certain embodiments, the formation of the O-linked GlcNAc is reduced by at least 5%, 7%, 10%, 12%, 15%, 18%, 20%, 25%, 30%, 35%, 40%, 45%, 50%, 55%, 60%, 65%, 70%, 75%, 80%, 85%, 90%, 95%, or 100% from the formation of the O-linked GlcNAc in a reference *Leishmania* cell.

In certain embodiments, the at least one GlcNAc-transferase is selected from the group consisting of OGNT1, OGNT2 and OGNTL, and homologous GlcNAc-transferases thereof. In certain embodiments, the at least one GlcNAc-transferase is a GlcNAc-transferase that is homologous to OGNT1, OGNT2 and/or OGNTL. In certain embodiments, the of the at least one GlcNAc-transferase is one, two or three.

In certain embodiments, the growth rate of the *Leishmania* cell is at least 60%, 65%, 70%, 75%, 80%, 85%, 90%, 95%, or 100% of the growth rate of a reference *Leishmania* cell.

In certain embodiments, the cell is *Leishmania tarentolae*.

In certain embodiments, the polypeptide is selected from the group consisting of adalimumab, rituximab and erythropoietin (EPO).

In certain embodiments, the *Leishmania* cell comprises a recombinant nucleic acid encoding a heterologous glycosyltransferase. In certain embodiments, the heterologous glycosyltranferase is an N-acetyl glucosamine transferase; and/or a heterologous galactosyltransferase; and/or a heterologous sialyltransferase. In certain embodiments, the in *Leishmania* cell comprises one or more heterologous glycosyltransferases. In certain embodiments, the *Leishmania* cell comprises one or more N-acetyl glucosamine transferases; and/or one or more heterologous galactosyltransferases; and/or one or more heterologous sialyltransferases.

In another aspect, provided herein is a method of making a polypeptide comprising (a) culturing the *Leishmania* cell provided herein under suitable conditions for polypeptide production; and (b) isolating the polypeptide.

In yet another aspect, provided herein is a polypeptide produced by the method provided herein.

3.1 Definitions

As used herein and unless otherwise indicated, the term "about," when used in conjunction with a number, refers to any number within ±1, ±5 or ±10% of the referenced number.

As used herein and unless otherwise indicated, the term "subject" refers to an animal (e.g., birds, reptiles, and mammals). In another embodiment, a subject is a mammal including a non-primate (e.g., a camel, donkey, zebra, cow, pig, horse, goat, sheep, cat, dog, rat, and mouse) and a primate (e.g., a monkey, chimpanzee, and a human). In certain embodiments, a subject is a non-human animal. In some embodiments, a subject is a farm animal or pet (e.g., a dog, cat, horse, goat, sheep, pig, donkey, or chicken). In a specific embodiment, a subject is a human. The terms "subject" and "patient" may be used herein interchangeably.

As used herein and unless otherwise indicated, the term "effective amount," in the context of administering a therapy (e.g., a composition described herein) to a subject refers to the amount of a therapy which has a prophylactic and/or therapeutic effect(s). In certain embodiments, an "effective amount" refers to the amount of a therapy which is sufficient to achieve one, two, three, four, or more of the following effects: (i) reduce or ameliorate the severity of a disease/disorder or symptom associated therewith; (ii) reduce the duration of a disease/disorder or symptom associated therewith; (iii) prevent the progression of a disease/disorder or symptom associated therewith; (iv) cause regression of a disease/disorder or symptom associated therewith; (v) prevent the development or onset of a disease/disorder, or symptom associated therewith; (vi) prevent the recurrence of a disease/disorder or symptom associated therewith; (vii) reduce organ failure associated with a disease/disorder; (viii) reduce hospitalization of a subject having a disease/disorder; (ix) reduce hospitalization length of a subject having a disease/disorder; (x) increase the survival of a subject with a disease/disorder; (xi) eliminate a disease/disorder in a subject; and/or (xii) enhance or improve the prophylactic or therapeutic effect(s) of another therapy.

3.2 Conventions and Abbreviations

| Abbreviation | Convention |
|---|---|
| CDS | Coding sequence |
| EPO | Erythropoietin |
| GlcNAc-transferase | N-acetylglucosamine-transferase |
| IR | Intergenic region |
| GalNAc | N-acetylgalactosamine |
| Fuc | Fucose |
| Glc | Glucose |
| GlcNAc | N-acetylglucosamine |
| HexNAc | N-acetylhexosamines |
| OGT or OGNT | O-glycosyltransferase |
| ORF | Open reading frames |
| UTR | Untranslated region |
| Man3 | 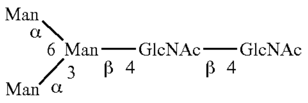 |
| G0-N | 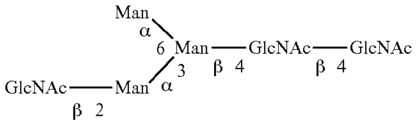 |
| G0 | 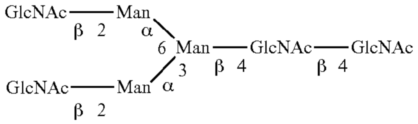 |
| G1-N | 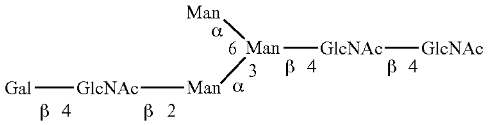 |
| G1 | 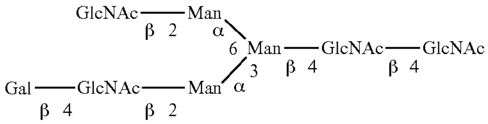 or 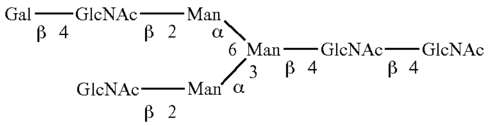 |

-continued 3.2 Conventions and Abbreviations

| Abbreviation | Convention |
|---|---|
| G1S1-N | 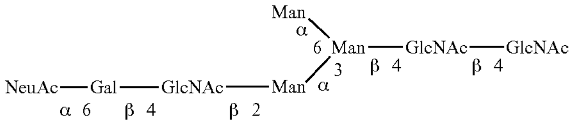 |
| G2 | 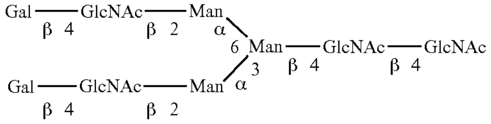 |
| G1S1 | 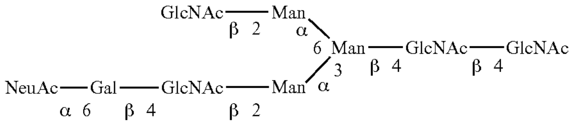 or 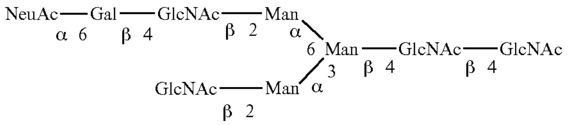 |
| G2S1 | 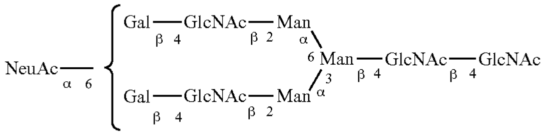 |
| G2S2 | 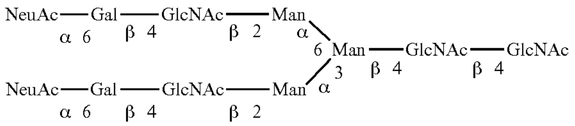 |

4. BRIEF DESCRIPTION OF THE FIGURES

FIG. 1: An O-glycopeptide with the mass addition corresponding to one HexNAc was identified on recombinant Erythropoietin produced by the CustomGlycan host cells. Occupied glycopeptides in the enriched fractions are shown in acquired spectra both in reflectron positive (upper spectra R+) and linear positive (lower spectra L+) MALDI modes.

FIGS. 2A-2D: O-HexNAc is located at the Thr225 within the hinge region of CustomGlycan produced recombinant human IgG1 (FIG. 2A) Deconvoluted mass spectrum of intact mass measurement of full length antibody shows Adalimumab with two N-linked Man3 as the main species. Further, two forms are observed carrying additionally one or two HexNAc modifications (+203 Da). (FIG. 2B) Deconvoluted mass spectra for the two peaks observed in the intact mass measurement of the reduced Adalimumab sample showed the masses expected for the light chain (Peak A) and for the heavy chain+Man3 (Peak B). For the heavy chain peak, a form modified with a HexNAc (+203 Da) was also observed showing that the HexNAc modification is localized on the heavy chain. (FIG. 2C) Deconvoluted mass spectra of the Fd subunit derived from a IdeS digest confirmed the presence of the HexNAc (+203 Da) on the Fd part of the heavy chain. (FIG. 2D) The major glycosylation site for the HexNAc was confirmed to be localized on a Threonine N-terminal of the hinge region. The targeted peptide measurement of a tryptic digest using ETD fragmentation clearly confirmed the HexNAc on Thr225 by the presence of c- and z-ions origination from the break of the proximate peptide bonds.

Figure 3A:
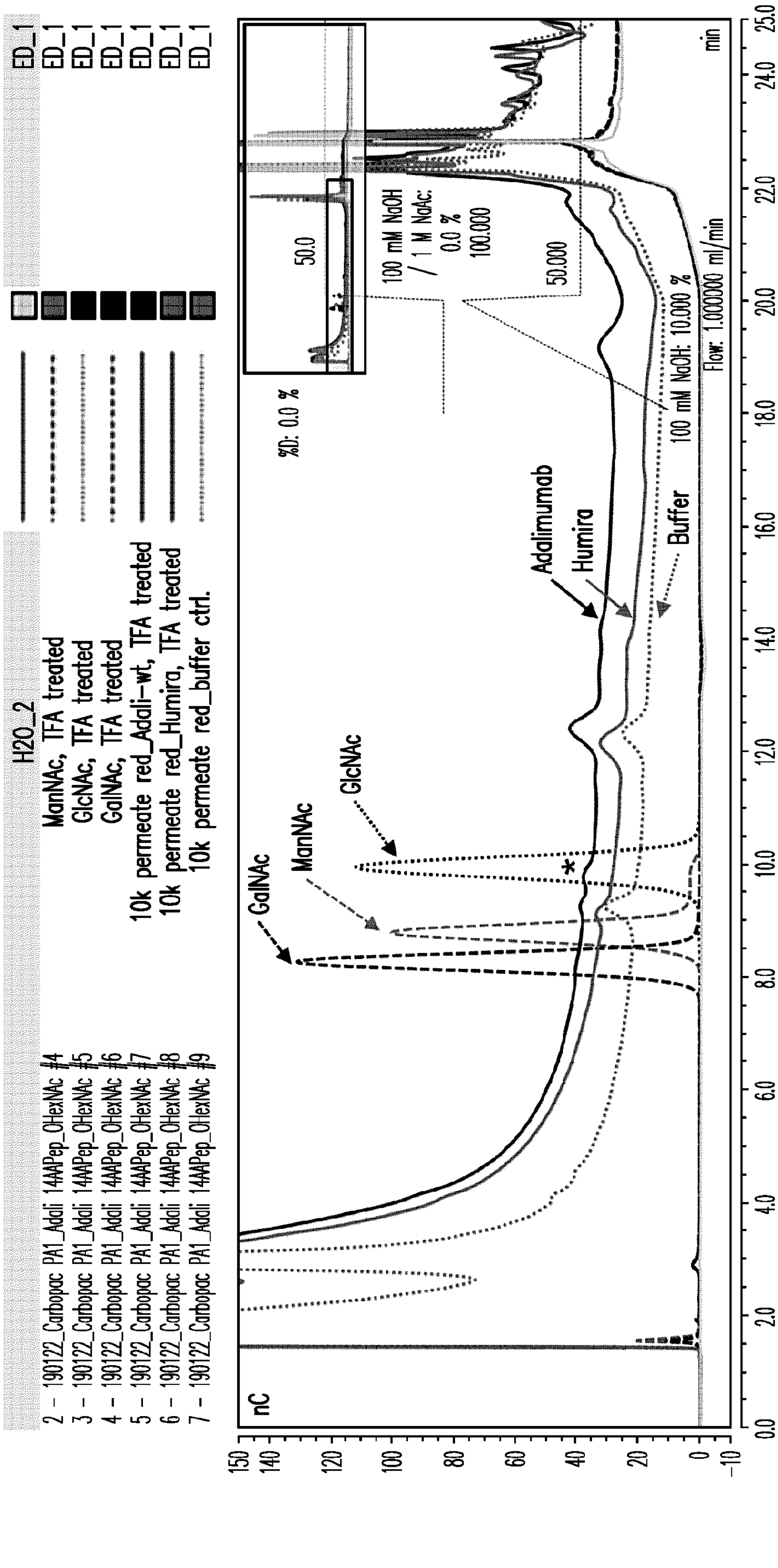
Figure 3B:
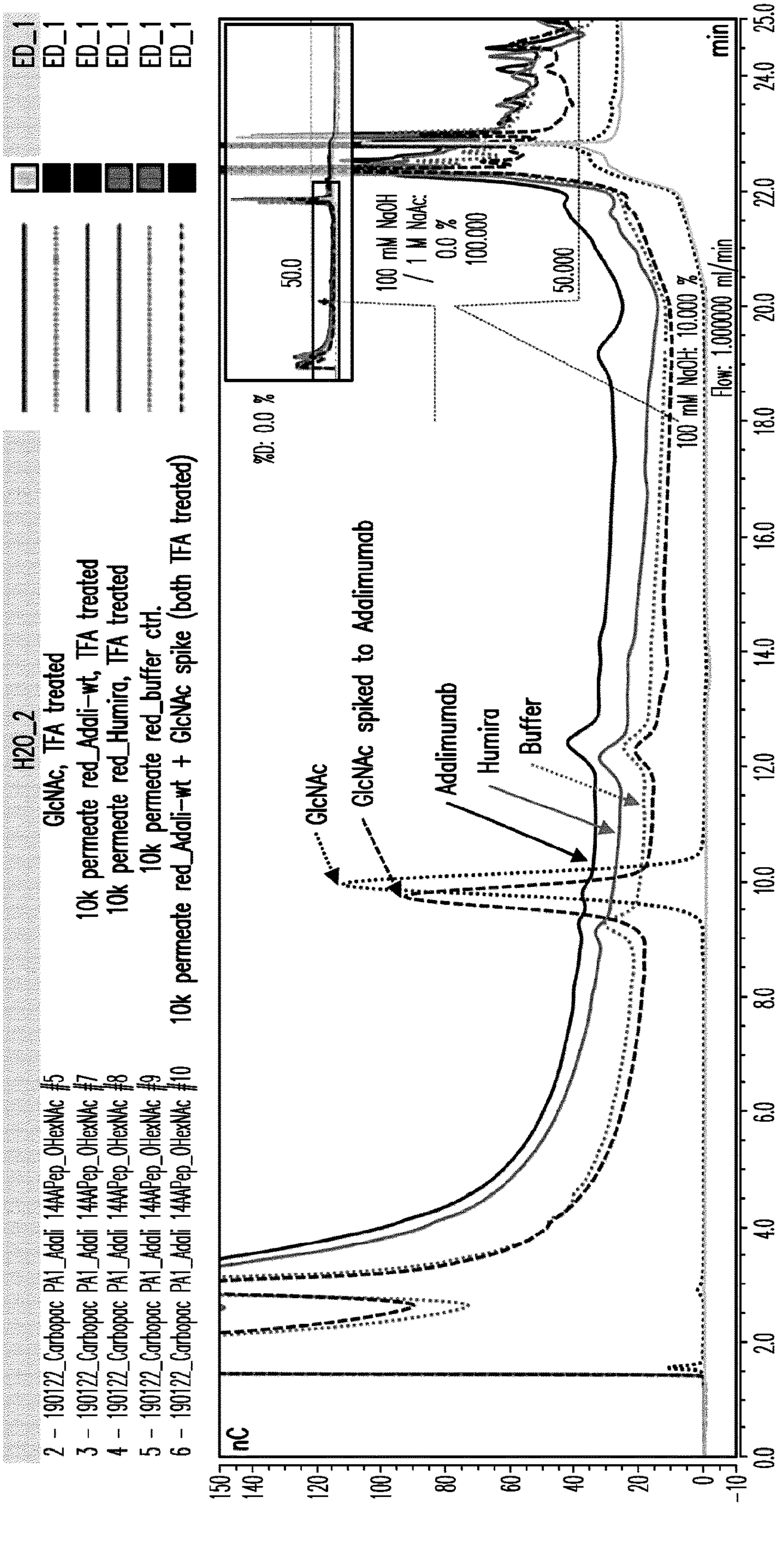

FIGS. 3A-3B: High performance anion exchange chromatography coupled with pulsed amperometric detection (HPAEC-PAD) suggests GlcNAc being the monosaccharide in O-linked HexNAc containing Adalimumab. (FIG. 3A) An overlay of traces of HPAEC-PAD runs of water blank, GlcNAc (black dotted), GalNAc (black dashed) and ManNAc (grey dashed) standards with buffer control (grey dotted), hydrolysis of Humira control (grey) and hydrolysis of Adalimumab carrying the O-HexNAc (black). One peak, indicated with a star, not present in buffer and Humira control was observed at RT 9.767 min, a bit shifted compared the GlcNAc standard (RT 9.95). (FIG. 3B) Overlay of traces of HPAEC-PAD runs of water blank, GlcNAc standard (black dotted), hydrolysis of Humira control (grey), hydrolysis of Adalimumab carrying the O-HexNAc (black), buffer control (grey dotted) and hydrolysis of Adalimumab carrying the O-HexNAc spiked with GlcNAc standard (black dashed). Spiking the GlcNAc standard into the sample matrix shifted the elution of GlcNAc slightly (RT 9.725), resulting in a match of RT between the O-HexNAc peak (Adalimumab, black) not present in the Humira control (grey) and the GlcNAc standard (black dotted).

Figure 4A:
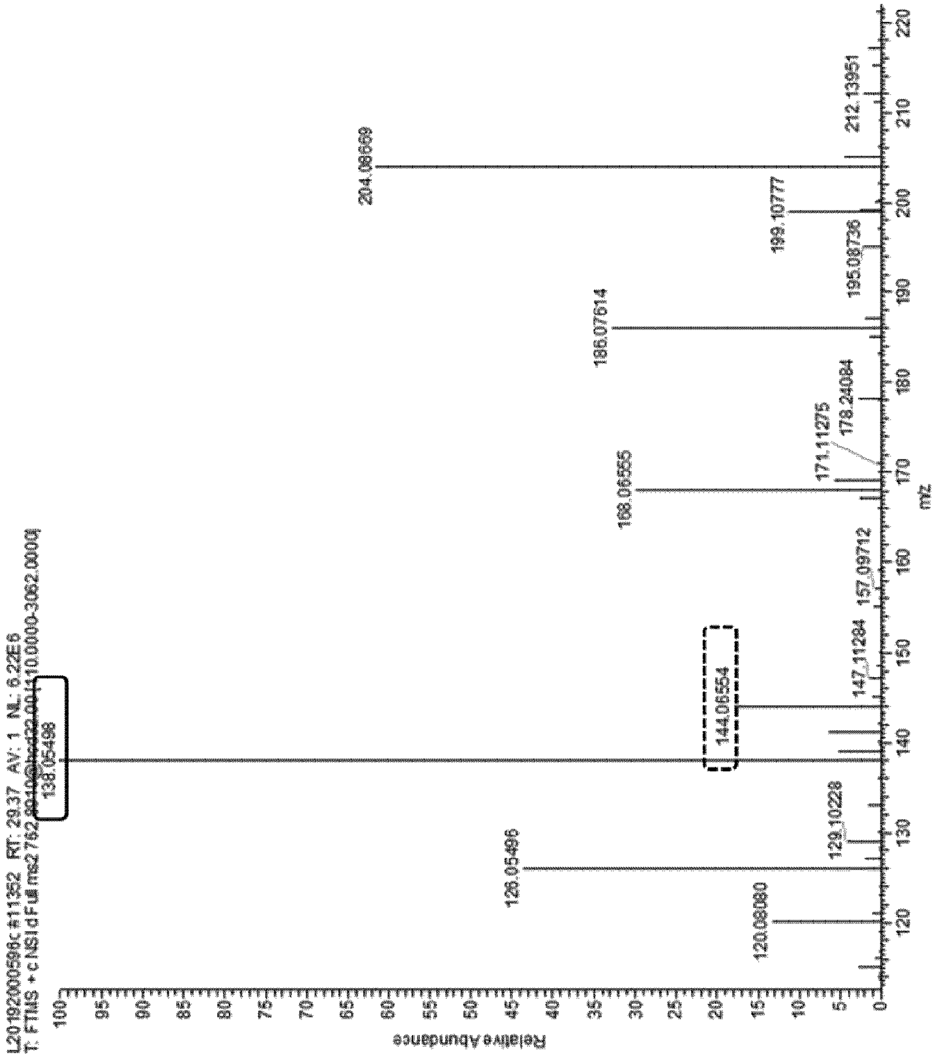
Figure 4B:
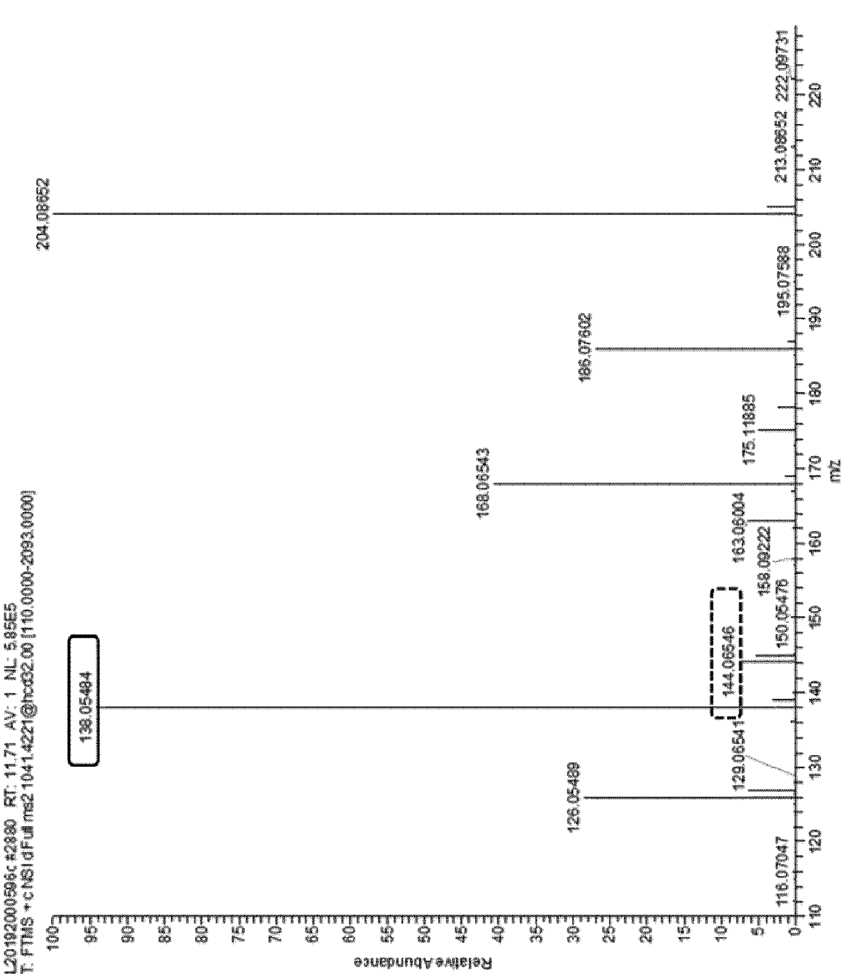
Figure 4C:
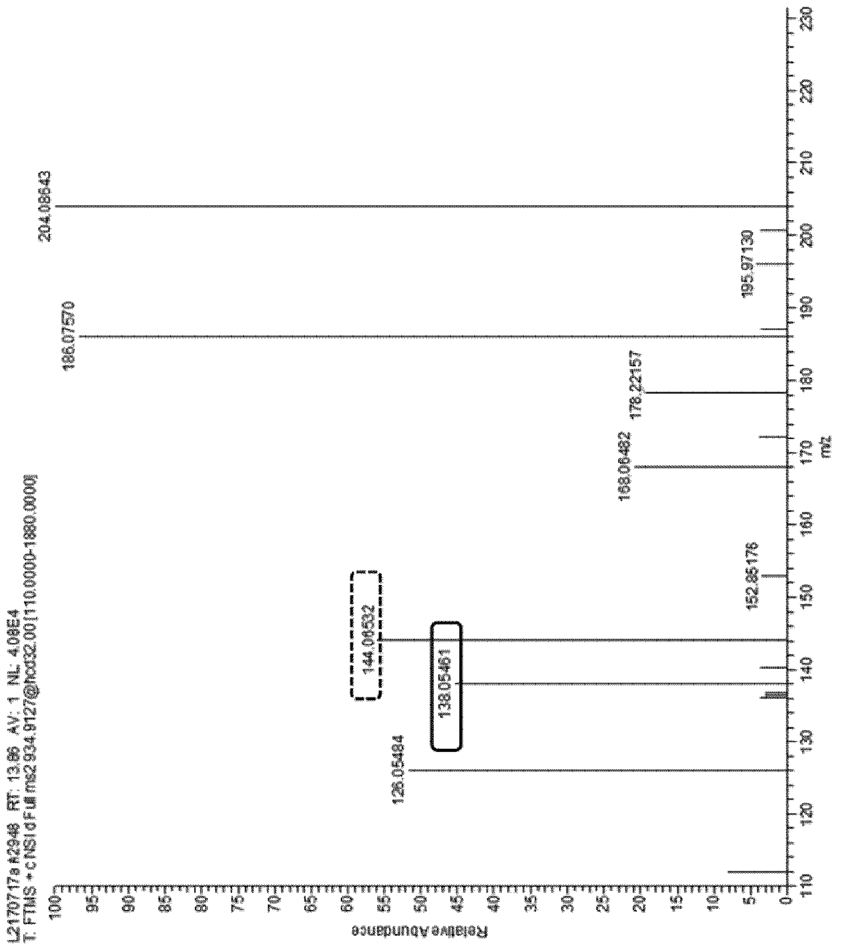

FIGS. 4A-4C: Indicative pattern of oxonium ions in HCD MS/MS spectra support the presence of O-linked GlcNAc on Thr225 within recombinantly produced Adalimumab. (FIG. 4A) Pattern of the HexNAc oxonium ions in the MS/MS spectrum of the tryptic peptide (THTCPPCPAPELLGGPSVFLFPPKPK) (SEQ ID NO:227) carrying the O-HexNAc on Thr225 (m/z 762.641) from the HexNAc mAb sample (FIG. 4B) Intensity of the HexNAc oxonium ions in the MS/MS spectrum of the tryptic peptide (EEQYNSTYR) (SEQ ID NO: 228) from the HexNAc mAb, carrying the N-glycan Man3, (FIG. 4C) Pattern of HexNAc oxonium ions of a tryptic peptide from CD43 (MoxYTTSITSDPK) (SEQ ID NO:229) carrying three GalNAc.

Figure 5A:
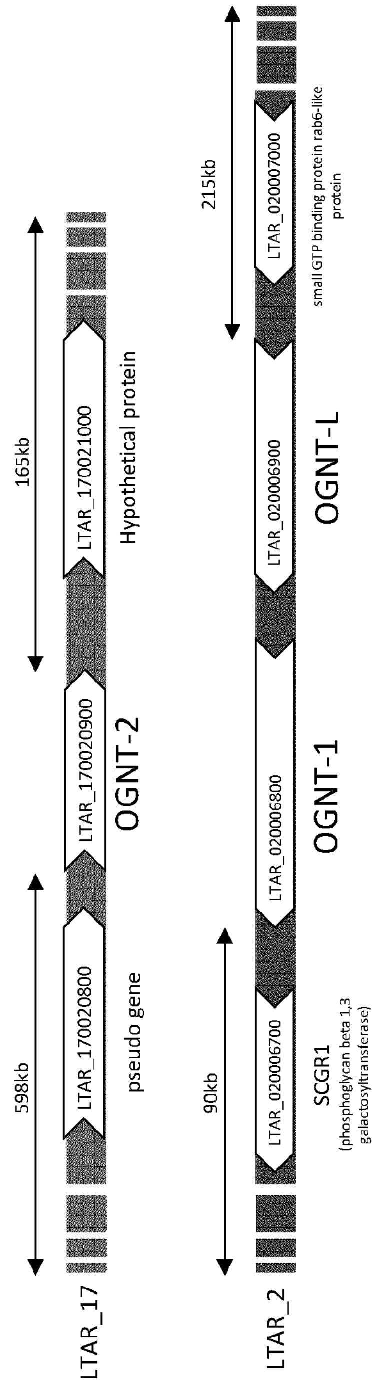
Figure 5B:
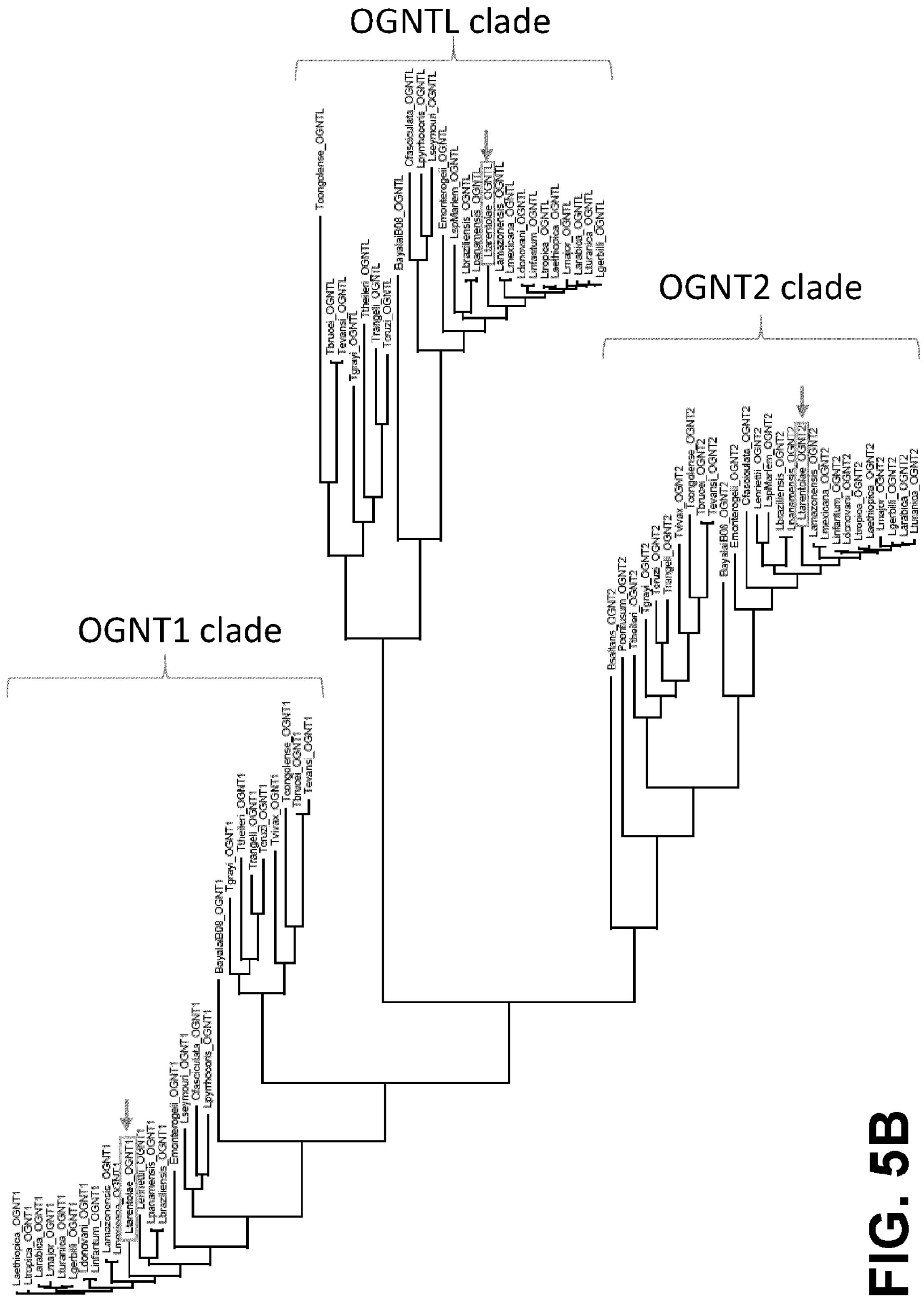
Figure 5C:
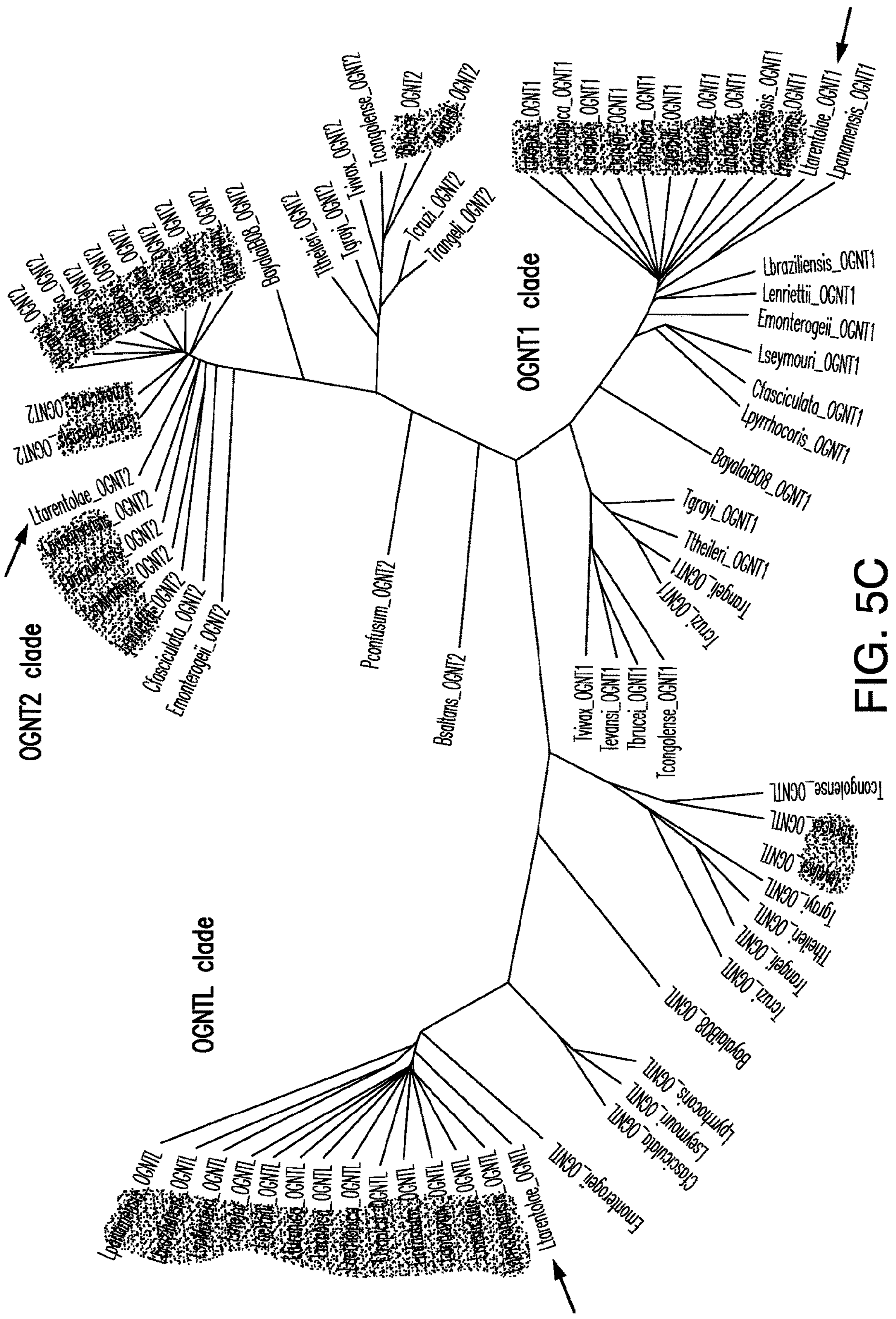

FIGS. 5A-5C: (FIG. 5A) Genomic location of three OGNT candidate genes in *Leishmania tarentolae* St10569. OGNT-2 (LTAR_170020900) is found on chromosome LTAR_17, OGNT-1 and OGNT-L (LTAR_020006800 and LTAR_020006900, respectively) is found on chromosome LTAR_2. Arrows denote directionality (5' to 3') of the genes. Double-headed arrows denote approximate distance to chromosome ends. (FIG. 5B) (FIG. 5C) OGNT homologues in other Kinetoplastida. Kinetoplastida genomes were downloaded from tritrypdb.org, *T. cruzi* OGNTs were used as reference query, the matches were tested by reciprocal best hits on *L. tarentolae* OGNTs. For each species, one representative isolate has been chosen and a total of 81 sequences were used to build a phylogenetic tree by multiple sequence alignment using T-coffee and the phylogenetic tree using RAxML. The phylogenetic relationship is depicted as rectangular tree (FIG. 5B) and radial tree (FIG. 5C).

Figure 6:
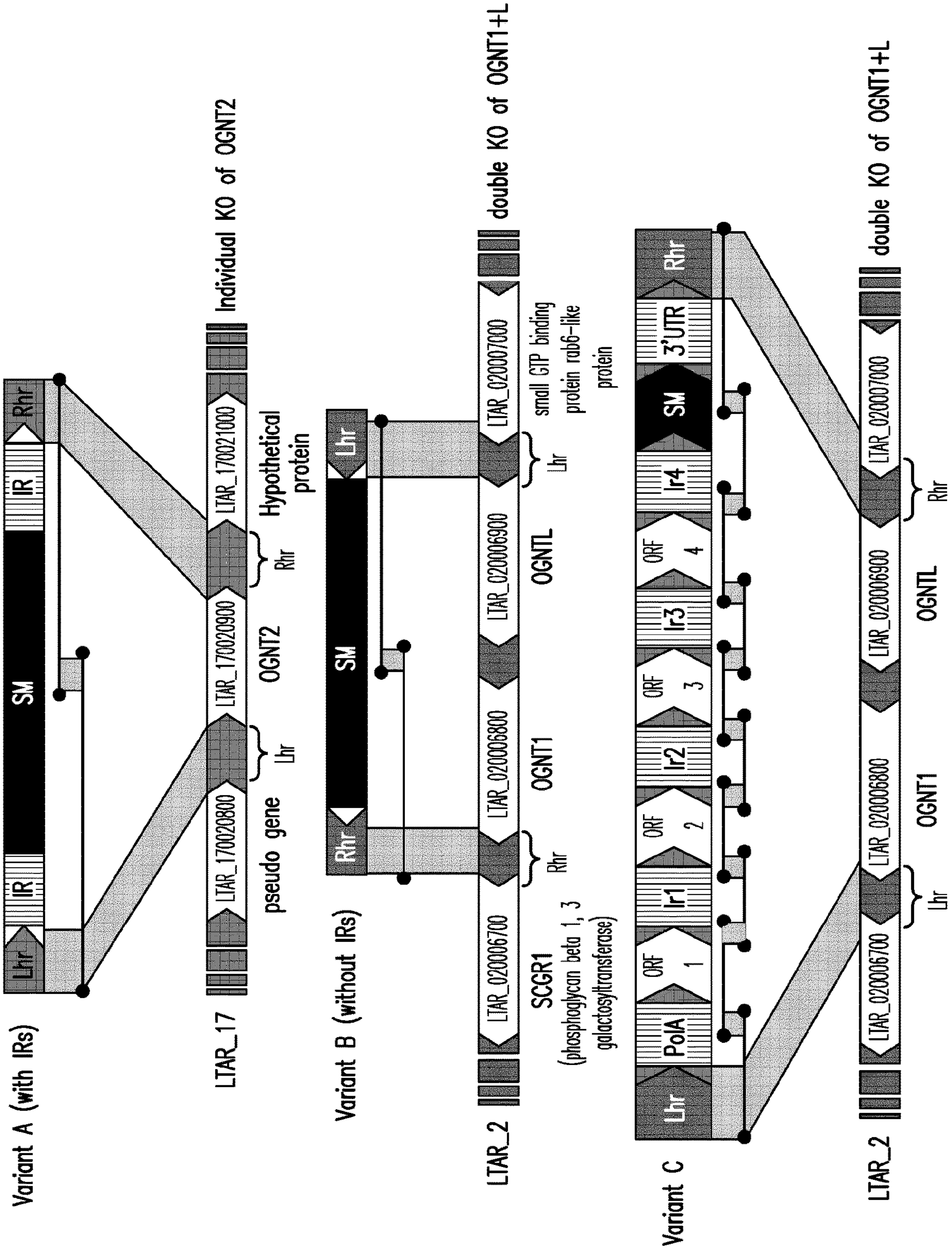

FIG. 6: Schematic representation of genomic deletions of OGNT candidate genes. Lhr denotes left (upstream) homologous recombination sequence, Rhr denotes right (downstream) homologous recombination sequence. Light grey bars depict homologous recombination events, replacing OGNT-2 with an intergenic region (IR), selection marker (SM), and IR (Variant A) or replacing OGNT-1 and OGNT-L by a selection marker only (Variant B). This results in an individual knockout of OGNT-2 and a double knockout of OGNT-1 and OGNT-L. Two fragments were used (depicted as line segments with 2 points at each end) to build the replacing fragment containing the selection marker. Variant C schematically demonstrates the replacement of OGNT-1 and OGNT-L by a functional construct for glycoengineering that contains 4 different enzymes (ORF1-ORF4) and a selection marker separated by intergenic regions (IR1-IR4).

Figure 7A:
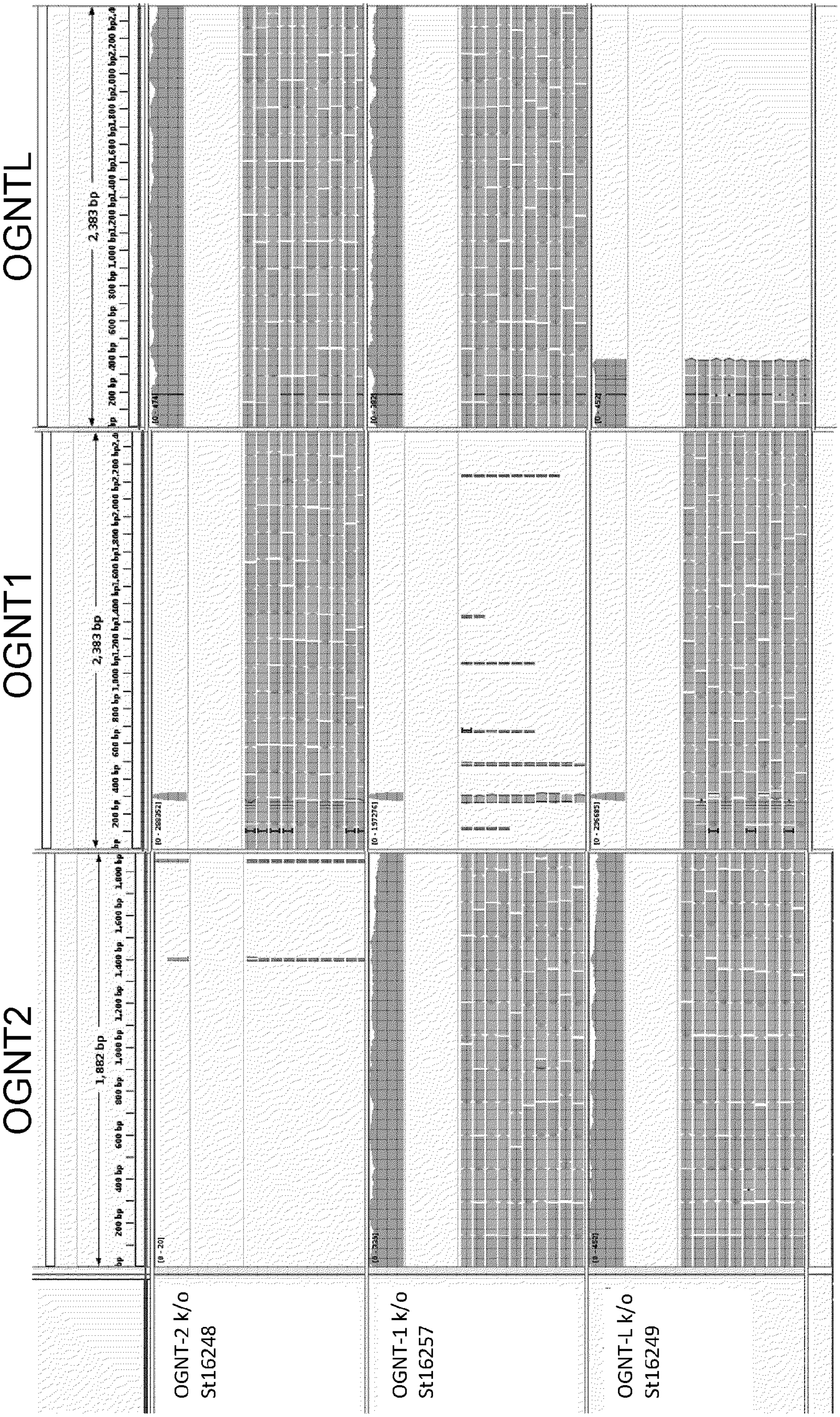
Figure 7B:
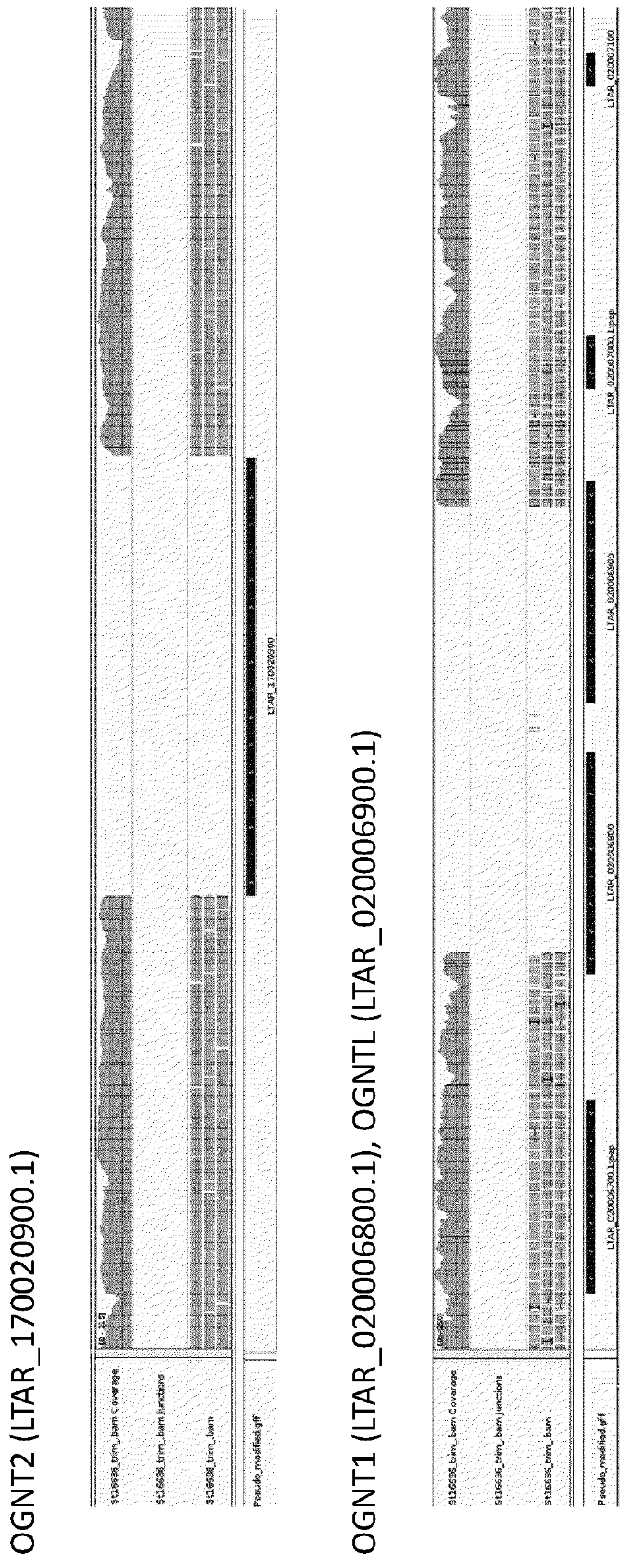

FIGS. 7A-7B: OGNT deletion was verified by Illumina deep sequencing. Absence of reads matching to the respective OGNT region as displayed in the IGV genomics browser confirm the successful deletion of single OGNT genes in strains St16248, St16257 and St16249 (FIG. 7A) and a double knockout of OGNT-1 and OGNT-L in strain St16636 (FIG. 7B).

Figure 8A:
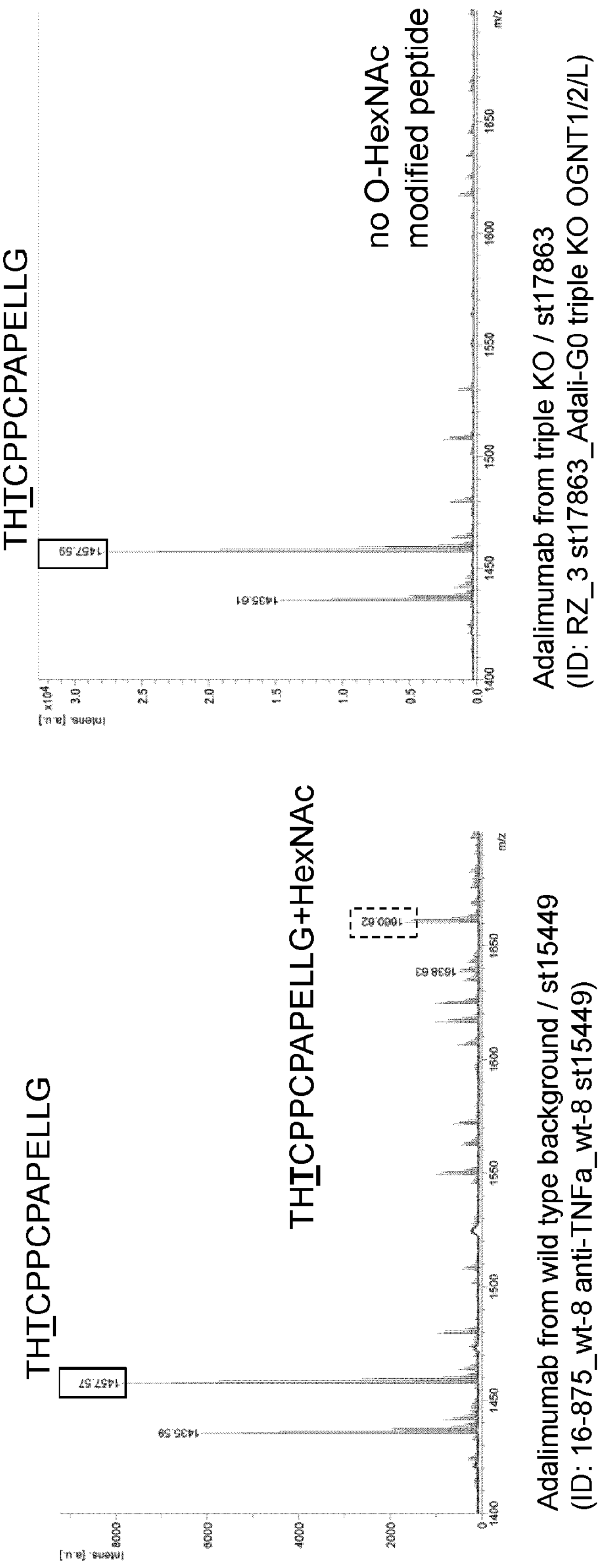
Figure 8B:
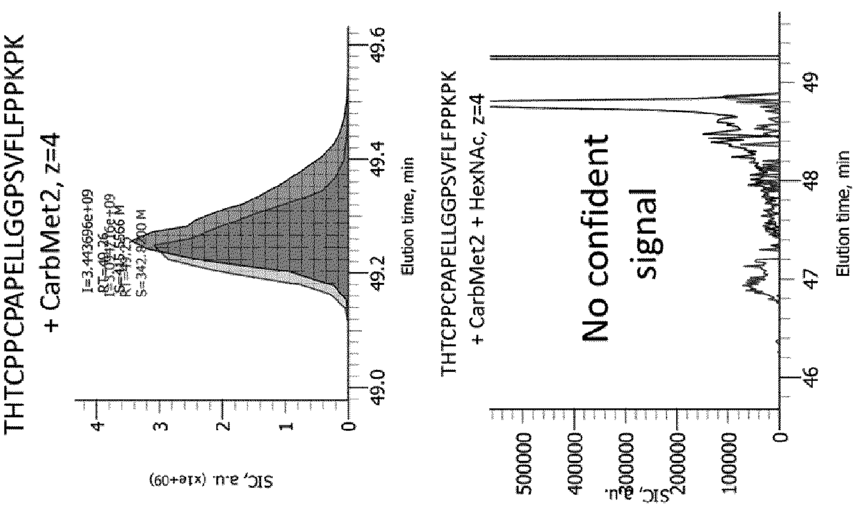

FIGS. 8A-8B: Confirmation of absence of O-HexNAc in a knock out (KO) cell line. (FIG. 8A) MALDI measurement of FabRICATOR (IdeS) and GingisKHAN (Kgp) double digest producing the 14 aa peptide THTCPPCPAPELLG (SEQ ID NO:230). For Adalimumab of the wt strain the peptide THTCPPCPAPELLG (SEQ ID NO:230) with and without HexNAc modification was observed (Na-adduct), for the triple KO cell line expressed Adalimumab only the THTCPPCPAPELLG (SEQ ID NO:230) peptide without an O-HexNAc modification was found. Marked sodium adducts of peptide with and without O-HexNAc are indicated. (FIG. 8B) The THTCPPCPAPELLGGPSVFLFPPKPK (SEQ ID NO: 227) peptide (+2*carbamidomethylation) without O-HexNAc modification was found with high abundance in the triple OGNT knock out CustomGlycan host cells, the THTCPPCPAPELLGGPSVFLFPPKPK (SEQ ID NO:227) peptide (+2*carbamidomethylation) with O-HexNAc modification could not be confirmed. The selected ion chromatogram (SIC) for the peptide with and without O-HexNAc (+2*carbamidomethylation) are shown in duplicates.

FIGS. 9A-9D: Modification of OGNT levels has no phenotypic impact on N-glycoengineered CustomGlycan *Leishmania* host cells. (FIG. 9A) N-glycan engineering up to G0 in the absence and presence of OGNT-1 overexpression. Relative N-glycan profiles of Adalimumab purified from a strain (St16292) co-expressing constructs for OGNT-1 overexpression («OE») and N-glycan engineering on Adalimumab («Adalimumab G0 OGNT-1 OE») and the parental glycoengineering strain (St15882, «Adalimumab G0») demonstrate that overexpression of OGNT1 has no effect on N-glycan engineering. (FIG. 9B) N-glycan engineering up to G0 in wt or OGNT triple knock-out background. Relative N-glycan profiles of Adalimumab purified from a glycoengineering strain mediating conversion up to G0 in wt background (St17607, «Adalimumab-G0»>) and upon knock-out of all three OGNT genes (St17863, "Adalimumab-G0, OGNT-1/2/L KO") demonstrate that knock-out of OGNTs has no effect on N-glycan engineering. (FIG. 9C) N-glycan engineering up to G2 in the wt or OGNT triple knock-out background. Relative N-glycan profiles of Adalimumab purified from a glycoengineering strain mediating conversion up to G2 in wt background (St15451, "Adalimumab-G2") and upon knock-out of all three OGNT genes (St17318, "Adalimumab-G2, OGNT-1/2/L KO") demonstrate that knock-out of OGNTs has no effect on N-glycan extension up to G2. (FIG. 9D) Representative PCR control for OGNT-2 replacement by selection marker (left) covers the whole endogenous locus by amplification with primers oLMTB6043 and oLMTB6044. It results for the wild type (wt) control in a fragment of 3.3 kbp, while the knock-out strains exhibit fragments of 2.2 kbp (exemplarily shown for clone St17317 from same transfection as St17318). Here in both cases, replacement was done by selection marker CDS without addition of IRs. Representative PCR control for OGNT-1+L replacement by selection marker (right) covers the whole endogenous locus by amplification with primers oLMTB6157 and oLMTB6156. It results for the wt control in a fragment of 8.1 kbp, while the knock-out strains exhibit fragments of 3.1 kbp for positive control St16704 where the CDS of the selection marker is flanked by additional IRs and 1.5 kbp for the analyzed strain St17317 where no extra IRs are used.

Figure 10A:
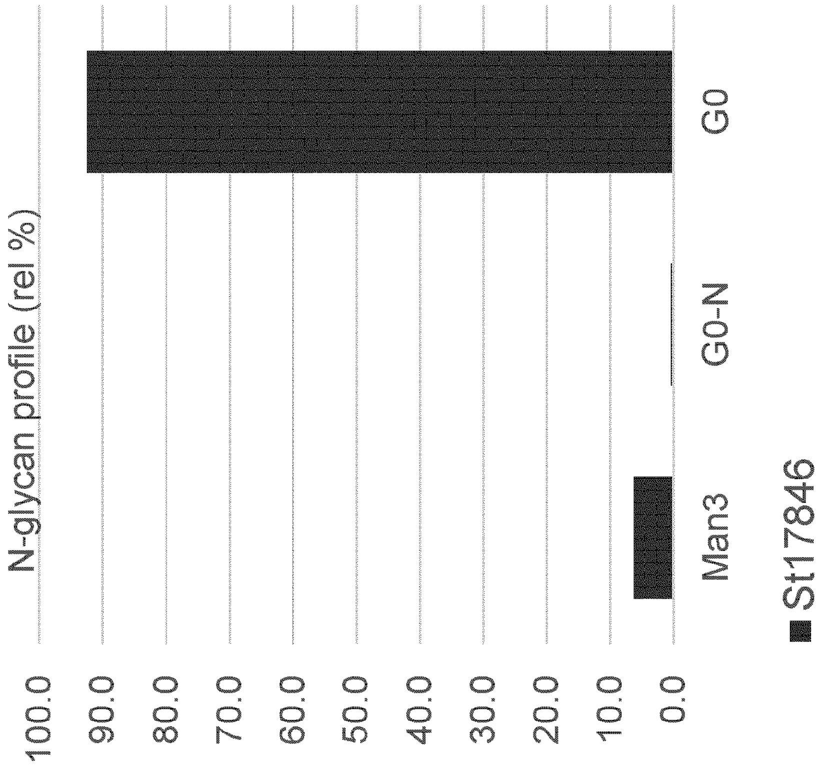
Figure 10B:
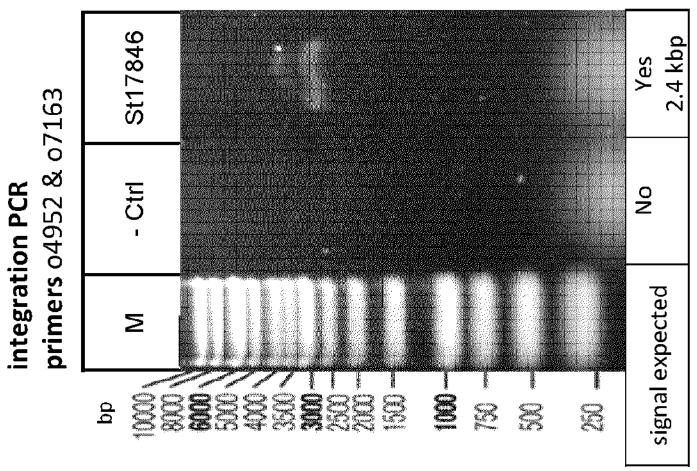

FIGS. 10A-10B: Replacement of OGNT genes by a glycosyltransferase expression cassette. (FIG. 10A) Relative N-glycan profile of Adalimumab purified from a strain (St17846) expressing a constructs for N-glycan engineering on Adalimumab from the endogenous OGNT-1/L locus. (FIG. 10B) PCR control for integration of the GT expression construct into the OGNT-1/L locus. Amplification with primers oLMTB4952 and oLMTB7163 does not result in a product in the wild type OGNT gene, but can amplify the 3' part of the correctly integrated construct between the selection marker hygromycin (hyg) and the 3' UTR of OGNT-L (2.4 kbp).

Figure 11:
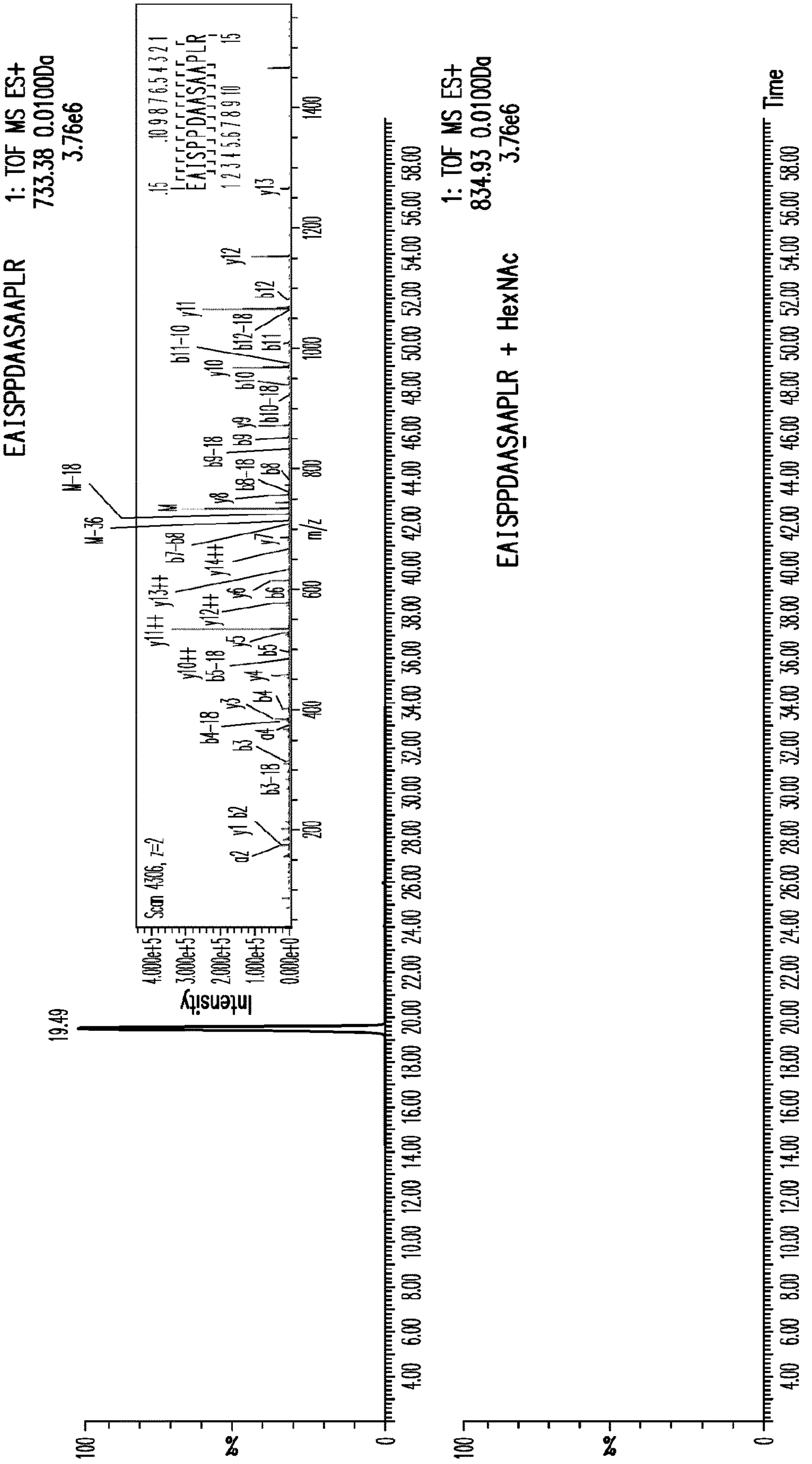

FIG. 11: Extracted ion chromatograms (XICs) of masses corresponding to unmodified (top panel; m/z 733.38) or O-HexNAc-modified (bottom panel; m/z 834.93) doubly charged tryptic peptides originating from LMSAP-rhEPO-Strep. The inset in the top panel shows the MS/MS fragmentation spectrum of the unmodified peptide [EAISPPDAASAAPLR] (SEQ ID NO:237). There was no evidence for the presence of masses corresponding to the peptide carrying an O-HexNAc modification (represented by EAISPPDAASAAPLR+HexNAc) (SEQ ID NO:237+HexNAc). (bottom panel).

FIGS. 12A-12E: ribonucleoprotein (RNP) mediated OGNT triple knock-outs in glycoengineering cell lines. (FIG. 12A) Schematic drawing of the transfection steps involved in the generation of strains St20097, St19855, St19931, St19915 and St19998, which are described in Example 9. Transfections are indicated by arrows and a short name of the transfected knock-out or construct is indicated in italics. (FIG. 12B) PCR control for the removal of WT OGNT-1, OGNT-2 and OGNT-L genes by transfection of RNPs. Primer pairs oLMTB7174/oLMTB7173 (probing for the endogenous sequence of OGNT-1), oLMTB7176/oLMTB7175 (probing for the endogenous sequence of OGNT-L) and OLMTB7492/oLMTB7495 (probing for the endogenous sequence of OGNT-2) produced amplicons of the proper sizes for WT gDNA from strain St18344, while no amplicon was obtained for St19855 derived gDNA or the technical control using $H_2O$ instead of template DNA. (FIG. 12C) N-glycan engineering up to G0 before and after OGNT triple knock-out by RNP transfection. Relative N-glycan profiles of surface glycoproteins from parental glycoengineering strain St19462 and the derived OGNT knock-out strain St20097 demonstrate that overexpression of OGNT knock-out by RNP transfection has no effect on previously performed N-glycan engineering. (FIG. 12D) MALDI measurement of FabRICATOR (IdeS) and GingisKHAN (Kgp) double digest producing the 14 aa peptide THTCPPCPAPELLG (SEQ ID NO:230). After transfection of an Adalimumab expression construct into the triple KO cell line St19855, the expressed antibodies were analyzed for the presence of the O-HexNAc modification on the 14 aa peptide THTCPPCPAPELLG (SEQ ID NO: 230). Only peptides without an O-HexNAc modification were detected. (FIG. 12E) N-glycan engineering after RNP mediated triple OGNT knock-out. Relative N-glycan profiles of Adalimumab (Fc) purified from the triple knock-out strain St19915 harboring the original 2 glycoengineering modules or the further modified triple knock-out strain St19998 containing in total 3 glycoengineering modules to G0 showed the desired improvement upon further glycoengineering. For St19915, 2% of other N-glycan biogenesis intermediates were detected (not shown).

5. DETAILED DESCRIPTION OF THE INVENTION

Provided herein are *Leishmania* cells, methods of making a target polypeptide using a *Leishmania* cell, and target polypeptides produced by the methods. In certain embodiments, provided herein are *Leishmania* cells which have been modified to control O-glycosylation, such as reduction in O-glycosylation or deletion of O-glycans. These *Leishmania* cells can also produce homogeneous and fully function-customized N-glycans with a high site occupancy on recombinant therapeutic proteins by the properties of the host cell and the combination with the heterologous expression of a set of glycosyltransferases, including N-acetyl glucosamine transferases, galactosyltransferase, and sialyltransferases. For example, the *Leishmania* cells provided herein can be used within the CustomGlycan Platform (International Publication No. WO2019/002512 A2, incorporated by reference in its entirety herein). Also provided herein are nucleic acid sequences and methods, which can be used to delete or control O-glycosylation enzymes, for example O-glycosylation enzymes involved in N-acetyl glucosamine transfer to serine or threonine residues in polypeptides.

Provided herein is a *Leishmania* host cell in which a gene encoding an enzyme that catalyzes the formation of O-linked GlcNAc has been functionally inactivated. Such genes are described in Section 5.1. Methods for accomplishing such functional inactivation are described in Section 5.2. Properties of the resulting *Leishmania* cell are described in Section 5.3. Uses of such *Leishmania* cell as expression systems for, e.g., therapeutic proteins are described in Section 5.4. Properties of the proteins expressed in *Leishmania* host cells provided herein are described in Section 5.5.

5.1 Enzyme that Catalyzes the Formation of O-Linked GlcNAc

Provided herein is a *Leishmania* host cell genetically engineered such that the formation of an O-linked GlcNAc on a polypeptide in the *Leishmania* cell is reduced or eliminated. In certain embodiments, the formation of O-linked GlcNAc in the *Leishmania* cell prior to genetic engineering is catalyzed by at least one N-acetylglucosamine (GlcNAc)-transferase. In certain embodiments, the gene encoding an enzyme that catalyzes the formation of O-linked GlcNAc has been functionally inactivated.

In certain embodiments, the enzyme that catalyzes the formation of O-linked GlcNAc is an N-acetylglucosamine (GlcNAc)-transferase. In certain embodiments, the GlcNAc-transferase is selected from the group consisting of OGNT1, OGNT2, OGNTL, and homologous GlcNAc-transferases thereof. In certain embodiments, the GlcNAc-transferase is OGNT1. In other embodiments, the GlcNAc-transferase is OGNT2. In yet other embodiments, the GlcNAc-transferase is OGNTL. In certain embodiments, the GlcNAc-transferase is a GlcNAc-transferase that is homologous to OGNT1. In certain embodiments, the GlcNAc-transferase is a GlcNAc-transferase that is homologous to OGNT2. In certain embodiments, the GlcNAc-transferase is a GlcNAc-transferase that is homologous to OGNTL. In certain embodiments, the GlcNAc-transferase is derived from *Leishmania tarentolae*. In certain embodiments, the GlcNAc-transferase is derived from other Trypanosomatida species. Nonlimiting examples of GlcNAc-transferases in Trypanosomatida are listed in Table 1, in which one representative genome per species is listed.

TABLE 1

Exemplary GlcNAc-transferases in Trypanosomatida.

| Species | Strain/TriTrypDB Genome accession | OGNT1 | OGNT2 | OGNTL |
|---|---|---|---|---|
| *Blechomonas ayalai* | TriTrypDB-44_BayalaiB08-376_AnnotatedProteins | rna_Baya_228_0070-1-p1 | rna_Baya_014_0750-1-p1 | rna_Baya_228_0080-1-p1 |

TABLE 1-continued

Exemplary GlcNAc-transferases in Trypanosomatida.

| Species | Strain/TriTrypDB Genome accession | OGNT1 | OGNT2 | OGNTL |
|---|---|---|---|---|
| *Bodo saltans* | TriTrypDB-44_BsaltansLakeKonstanz AnnotatedProteins | none | BSAL_53670-t42_1-p1 | None |
| *Crithidia fasciculata* | TriTrypDB-44_CfasciculataCfCl_AnnotatedProteins | CFAC1_160013000.1-p1 | CFAC1_090018200.1-p1 | CFAC1_160013300.1-p1 |
| *Endotrypanum monterogeii* | TriTrypDB-44_EmonterogeiiLV88_AnnotatedProteins | EMOLV88_020005500.1-p1 | EMOLV88_170014900.1-p1 | EMOLV88_020005600.1-p1 |
| *Leishmania aethiopica* | TriTrypDB-44_LaethiopicaL147_AnnotatedProteins | LAEL147_000030200.1-p1 | LAEL147_000253000.1-p1 | LAEL147_000030300.1-p1 |
| *Leishmania amazonensis* | TriTrypDB-44_LamazonensisMHOMBR71973M2269_AnnotatedProteins | LAMA_000035900.1-p1 | LAMA_000268900.1-p1 | LAMA_000036200.1-p1 |
| *Leishmania arabica* | TriTrypDB-44_LarabicaLEM1108_AnnotatedProteins | LARLEM1108_020007100.1-p1 | LARLEM1108_170015900.1-p1 | LARLEM1108_020007200.1-p1 |
| *Leishmania braziliensis* | TriTrypDB-44_Lbraziliensis MHOMBR75M2904_AnnotatedProteins | LbrM.02.0270:mRNA-p1 | LbrM.17.1130:mRNA-p1 | LbrM.02.0280:mRNA-pl |
| *Leishmania donovani* | TriTrypDB-44_LdonovaniCL-SL_AnnotatedProteins | LdCL_020007500-t42_1-p1 | LdCL_170017200-t42_1-p1 | LdCL_020007600-t42_1-p1 |
| *Leishmania enrietti* | TriTrypDB-44_LenriettiiLEM3045_AnnotatedProteins | LENLEM3045_000029600.1-p1 | LENLEM3045_170016400.1-p1 | None |
| *Leishmania gerbilli* | TriTrypDB-44_LgerbilliLEM452_AnnotatedProteins | LGELEM452020006800.1-p1 | LGELEM452170012100.1-p1 | LGELEM452_020006900.1-p1 |
| *Leishmania infantum* | TriTrypDB-44_LinfantumJPCM5_AnnotatedProteins | LINF_020007400-T1-p1 | LINF_170017300-T1-p1 | LINF_020007500-T1-p1 |
| *Leishmania major* | TriTrypDB-44_LmajorFriedlin_AnnotatedProteins | LmjF.02.0240:mRNA-p1 | LmjF.17.1020:mRNA-p1 | LmjF.02.02 50:mRNA-p1 |
| *Leishmania mexicana* | TriTrypDB-44_LmexicanaMHOMGT2001U1103_AnnotatedProteins | LmxM.02.0240.1-p1 | LmxM.17.1020.1-p1 | LmxM.02.0250.1-p1 |
| *Leishmania panamensis* | TriTrypDB-44_LpanamensisMHOMPA94PSC1_AnnotatedProteins | LPMP_020160-t37_1-p1 | LPMP_170990-t37_1-p1 | LPMP_020170-t37_1-p1 |
| *Leishmania pyrrhocoris* | TriTrypDB-44_LpyrrhocorisH10_AnnotatedProteins | rna_LpyrH1027_0530-p1 | none | rna_LpyrH10_27_0550-p1 |
| *Leishmania seymouri* | TriTrypDB-44_LseymouriATCC30220_AnnotatedProteins | rna_Lsey_03790030-1-p1 | none | rna_Lsey_0379_0020-1-p1 |
| *Leishmania* sp. *MAR* | TriTrypDB-44_LspMARLEM2494_AnnotatedProteins | none | LMARLEM2494_1700155001-p1 | LMARLEM2494_020006500.1-p1 |
| *Leishmania tropica* | TriTrypDB-44_LtropicaL590_AnnotatedProteins | LTRL590_020007500.1-p1 | LTRL590_000019100.1-p1 | LTRL590_020007600.1-p1 |
| *Leishmania turanica* | TriTrypDB-44_LturanicaLEM423_AnnotatedProteins | LTULEM423020006600.1-p1 | LTULEM423170015700.1-p1 | LTULEM423_020006700.1-p1 |
| *Paratrypanosoma confusum* | TriTrypDB-44_PconfusumCUL13_AnnotatedProteins | none | PCON_0046770.mRNA-p1 | None |
| *Trypanosoma brucei* | TriTrypDB-44_TbruceigambienseDAL972_AnnotatedProteins | Tbg.972.2.950:mRNA-p1 | Tbg972.5.3320:mRNA-p1 | Tbg.972.2.930:mRNA-p1 |
| *Trypanosoma congolense* | TriTrypDB-44_TcongolenseIL3000AnnotatedProteins | TcIL3000_0_43290.1-p1 | TcIL3000_5_2160.1-p1 | TcIL3000_2200.1-p1 |
| *Trypanosoma evansi* | TriTrypDB-44_TevansiSTIB805_AnnotatedProteins | TevSTIB805.2.1330-t26_1-p1 | TevSTIB805.5.2740-t26_1-p1 | TevSTIB805.2.1310-t26_1-p1 |

TABLE 1-continued

| Exemplary GlcNAc-transferases in Trypanosomatida. | | | | |
|---|---|---|---|---|
| Species | Strain/TriTrypDB Genome accession | OGNT1 | OGNT2 | OGNTL |
| *Trypanosoma grayi* | TriTrypDB-44_TgrayiANR4_AnnotatedProteins | DQ04_09771010-t26_1-p1 | DQ04_01951010-t26_1-p1 | DQ04_04291000-t26_1-p1 |
| *Trypanosoma rangeli* | TriTrypDB-44_TrangeliSC58_AnnotatedProteins | TRSC58_00083-t26_1-p1 | TRSC58_05317-t26_1-p1 | TRSC58_03864-t26_1-p1 |
| *Trypanosoma theileri* | TriTrypDB-44_TtheileriEdinburgh_AnnotatedProteins | TM35_000391720-t36_1-p1 | TM35_000201600-t36_1-p1 | TM35_000391740-t36_1-p1 |
| *Trypanosoma vivax* | TriTrypDB-44_TvivaxY486_AnnotatedProteins | TvY486_0200430:mRNA-p1 | TvY486_0501730:mRNA-p1 | TvY486_0200410:mRNA-p1 (Pseudogene) |

In certain embodiments, the enzyme that catalyzes the formation of O-linked GlcNAc is derived from species other than Trypanosomatida species. In certain embodiments, the enzyme is a human O-GlcNAc transferase (OGT, Uniprot: 015294) and homologous enzymes thereof. In certain embodiments, the O-GlcNAc transferase (OGT; uridine diphospho-N-acetylglucosamine: polypeptide β-N-acetylglucosaminyltransferase; EC 2.4.1.255) can catalyze the transfer of a single N-acetylglucosamine from UDP-GlcNAc to a serine or threonine residue in cytoplasmic and nuclear proteins resulting in their modification with a beta-linked N-acetylglucosamine (O-GlcNAc). In certain embodiments, the enzyme that catalyzes the formation of O-linked GlcNAc may be different isoforms of OGT. Exemplary isoforms of OGT include but are not limited to: (1) the nucleocytoplasmic or full-length variant (ncOGT), which may be 110 kDa; (2) a short isoform of OGT (sOGT), which may be 78 kDa; and (3) a variant of OGT that is targeted to the mitochondria (mOGT; which may be 90 kDa). In certain embodiments, OGT may appear to form multimers in the nucleus and cytoplasm, consisting of one or more 110-kDa subunits and 78-kDa subunits (Varki, Ajit, et al. (Eds.) (2015): Essentials of Glycobiology. Cold Spring Harbor Laboratory Press. 3rd. Cold Spring Harbor (NY)). In certain embodiments, the enzyme that catalyzes the formation of O-linked GlcNAc is human EOGT (Uniprot: Q5NDL2). In certain embodiments, the enzyme catalyzes the transfer of a single N-acetylglucosamine from UDP-GlcNAc to a serine or threonine residue in extracellular proteins resulting in their modification with a beta-linked N-acetylglucosamine (O-GlcNAc). In certain embodiments, the enzyme catalyzes Specific glycosylation of the Thr residue located between the fifth and sixth conserved cysteines of folded EGF-like domains.

In certain embodiments, the enzyme that catalyzes the formation of O-linked GlcNAc may transfer in alpha-linkage. In other embodiments, the enzyme that catalyzes the formation of O-linked GlcNAc may transfer in beta-linkage.

In certain embodiments, the formation of O-linked GlcNAc in the cell prior to genetic engineering is catalyzed by at least one enzyme as described in this Section, for example one, two, three, four, five, six, seven, eight, nine or ten enzymes as described in this Section.

In certain embodiments, the formation of O-linked GlcNAc in the cell prior to genetic engineering is catalyzed by at least one GlcNAc-transferase derived from Trypanosomatida species, for example *Leishmania tarentolae*. In certain embodiments, the formation of O-linked GlcNAc in the cell prior to genetic engineering is catalyzed by at least one GlcNAc-transferase, for example one, two, three, four, five, six, seven, eight, nine or ten GlcNAc-transferases, one or more of which is derived from Trypanosomatida species. In certain embodiments, the number of the at least one GlcNAc-transferase is one, two or three. In certain embodiments, the at least one GlcNAc-transferase is selected from the group consisting of OGNT1, OGNT2, OGNTL and homologous GlcNAc-transferases thereof. In certain embodiments, at least one GlcNAc-transferase is a GlcNAc-transferase that is homologous to OGNT1, OGNT2 and/or OGNTL.

In certain embodiments, the formation of O-linked GlcNAc in the cell prior to genetic engineering is catalyzed by at least one GlcNAc-transferase derived from species that is other than Trypanosomatida species, for example human. In certain embodiments, the formation of O-linked GlcNAc in the cell prior to genetic engineering is catalyzed by at least one GlcNAc-transferase, for example one, two, three, four, five, six, seven, eight, nine or ten GlcNAc-transferases, one or more of which is derived from human. In certain embodiments, the number of the at least one GlcNAc-transferase is one, two or three. In certain embodiments, the at least one GlcNAc-transferase is selected from the group consisting of human O-GlcNAc transferase and human EOGT and homologous enzymes thereof. In certain embodiments, at least one GlcNAc-transferase is an enzyme that is homologous to human O-GlcNAc transferase and/or human EOGT.

In certain embodiments, the enzyme catalyzes the formation of O-linked GlcNAc prior to the genetic engineering of a *Leishmania* cell. In certain embodiments, the enzyme still catalyzes the formation of O-linked GlcNAc after the genetic engineering of a *Leishmania* cell. In certain embodiments, the enzyme does not catalyze the formation of O-linked GlcNAc after the genetic engineering of a *Leishmania* cell.

5.2 Method of Genetically Engineering a *Leishmania* Cell

Provided herein are also methods of genetically engineering a *Leishmania* cell as described in Section 5.3. In certain embodiments, the method may be used to accomplish the functional inactivation of gene encoding an enzyme that catalyzes the formation of O-linked GlcNAc (as described in Section 5.1) in a *Leishmania* host cell.

5.2.1 Functional Inactivation of Gene Encoding an Enzyme that Catalyzes the Formation of O-Linked GlcNAc In certain embodiments, the gene encoding an enzyme that catalyzes the formation of O-linked GlcNAc may be functionally inactivated. In certain embodiments, the gene encoding the at least one GlcNAc-transferase is downregulated. In certain embodiments, the gene encoding the at least one GlcNAc-transferase is deleted. In certain embodiments, the gene encoding the at least one GlcNAc-transferase is mutated.

In certain embodiments, the gene encoding an enzyme that catalyzes the formation of O-linked GlcNAc may be functionally inactivated using the methods described in the Example Section (Section 6). In certain embodiments, the gene encoding an enzyme that catalyzes the formation of O-linked GlcNAc may be functionally inactivated using any method known in the art, for example methods described in International Publication No. WO2019/002512 A2, incorporated by reference in its entirety herein.

Non-limiting exemplary mutagenesis approaches include site directed mutagenesis using targeted gene editing techniques such as TALENs, ZFNs, CRISPR/Cas9; in combination with a repair scaffold for directed, homologous recombination mediated repair (Zhang, W et al. (2017) mSphere 2 (1); Gupta, R. and Musunuru, K. (2014) *The Journal of clinical investigation* 124 (10): 4154-4161), transposon mutagenesis (Damasceno, J. et al. (2015) Christopher Peacock (Ed.): Parasite Genomics Protocols, vol. 1201. New York, NY: Springer New York (Methods in Molecular Biology), pp. 235-245); replacing the endogenous copy in situ with selectional markers, potentially in combination with a mutated gene version, that are integrated by homologous recombination (Roberts, S. (2011) Bioeng Bugs 2 (6): 320-326); RNA interference (RNAi) (Lye, L. et al. (2010) *PLoS Pathog* 6 (10), e1001161), conditional knock-down using Cre/LoxP or FRT/FLP (Duncan, S. (2017) *Molecular and Biochemical Parasitology* 216:30-38).

In certain embodiments, the gene encoding the at least one GlcNAc-transferase is overexpressed. Such ovexpression may be accomplished by the following non-limiting exemplary approaches, such as gene copy number increase by introduction of additional copies into separate loci (Beverley, S. (1991): Gene amplification in *Leishmania*. In *Annu. Rev. Microbiol.* 45, pp. 417-444), high expression loci (ribosomal DNA loci) or episomal constructs (Lodes, M. et al. (1995) Mol Cell Biol 15 (12), pp. 6845-6853. DOI: 10.1128/mcb.15.12.6845; Boucher, N. (2004) Nucleic Acids Res 32 (9): 2925-2936), modification of the native UTRs flanking the coding sequence; introduction of additional promoter regions such as the endogenous PolI promoter or a T7 promoter in combination with expression of bacterial T7 polymerase to increase the expression levels (Boucher, N. et al. (2002) *Molecular and Biochemical Parasitology* 119 (1): 153-158; Gu, P. et al. (2015) Scientific reports 5, p. 9684), use of transposable elements or recombinase based systems such as FRT-FLP or Cre/LoxP to introduce multiple copies of an expression construct (Duncan, S. et al. (2017) *Molecular and Biochemical Parasitology* 216, pp. 30-38), minichromosome integration (Zomerdijk, J. et al. (1992) Nucleic acids research 20 (11): 2725-2734), and forced chromosomal translocation by CRISPR (Zhang, W. et al. (2017) mSphere 2 (1). DOI: 10.1128/mSphere.00340-16)

Any method known in the art can be used to engineer the *Leishmania* cell, e.g., *Leishmania tarentolae*. In certain embodiments, nucleic acids are introduced into the host cells described herein using a plasmid, e.g., the heterologous nucleic acids are expressed in the host cells by a plasmid (e.g., an expression vector), and the plasmid is introduced into the modified host cells by transfection, infection, or electroporation, chemical transformation by heat shock, natural transformation, phage transduction, or conjugation. In a specific embodiment, said plasmid is introduced into the modified host cells by stable transfection.

In specific embodiments, linearized nucleic acids are introduced into the host cells described herein using transfection, infection, or electroporation, chemical transformation by heat shock, natural transformation, phage transduction, or conjugation. In a further embodiment, heterologous nucleic acids are integrated site-specifically into the host cell genome by homologous recombination.

In certain embodiments, the genes encoding at least 1, 2, 3, 4, 5, 6, 7, 8, 9, 10, 11, 12, 13, 14, 15, 16, 17, 18, 19, or at least 20 enzymes that each catalyzes the formation of O-linked GlcNAc may be functionally inactivated. In certain embodiments, the genes encoding 1, 2, 3, 4, 5, 6, 7, 8, 9, 10, 11, 12, 13, 14, 15, 16, 17, 18, 19, or 20 enzymes that each catalyzes the formation of O-linked GlcNAc may be functionally inactivated. In certain embodiments, the genes encoding three enzymes that each catalyzes the formation of O-linked GlcNAc may be functionally inactivated. In certain embodiments, the genes and/or genetic loci that may be functionally inactivated include but are not limited to OGNT1, OGNT2, and OGNTL.

In certain embodiments, the genes encoding at least 1, 2, 3, 4, 5, 6, 7, 8, 9, 10, 11, 12, 13, 14, 15, 16, 17, 18, 19, or at least 20 GlcNAc-transferase that each catalyzes the formation of O-linked GlcNAc may be functionally inactivated. In certain embodiments, the genes encoding 1, 2, 3, 4, 5, 6, 7, 8, 9, 10, 11, 12, 13, 14, 15, 16, 17, 18, 19, or 20 GlcNAc-transferase that each catalyzes the formation of O-linked GlcNAc may be functionally inactivated. In certain embodiments, the genes encoding three GlcNAc-transferases that each catalyzes the formation of O-linked GlcNAc may be functionally inactivated.

In certain embodiments, the genes encoding at least 5%, 10%, 20%, 30%, 40%, 50%, 60%, 70%, 80%, 90%, or 100% of all enzymes that each catalyzes the formation of O-linked GlcNAc may be functionally inactivated. In certain embodiments, the genes encoding 5%, 10%, 20%, 30%, 40%, 50%, 60%, 70%, 80%, 90%, or 100% of all enzymes that each catalyzes the formation of O-linked GlcNAc may be functionally inactivated.

In certain embodiments, the genes encoding at least 5%, 10%, 20%, 30%, 40%, 50%, 60%, 70%, 80%, 90%, or 100% of all GlcNAc-transferases that each catalyzes the formation of O-linked GlcNAc may be functionally inactivated. In certain embodiments, the genes encoding 5%, 10%, 20%, 30%, 40%, 50%, 60%, 70%, 80%, 90%, or 100% of all GlcNAc-transferases that each catalyzes the formation of O-linked GlcNAc may be functionally inactivated.

5.2.2 Methods of Culturing Cells

Provided herein are methods for culturing host cells, for example *Leishmania* host cells.

In one embodiment, host cells are cultured using any of the standard culturing techniques known in the art. For example, cells are routinely grown in rich media like Brain Heart Infusion, Trypticase Soy Broth or Yeast Extract, all containing 5 μg/ml Hemin. Additionally, incubation is done at 26° C. in the dark as static or shaking cultures for 2-3 days. In some embodiments, cultures of recombinant cell lines contain the appropriate selective agents. Non-limiting exemplary selective agents are provided in Table 2.

In certain embodiments, host cells may be cultured using the methods described in the Assay and Examples Sections (Sections 5.6 and 6, respectively). Non-limiting exemplary *Leishmania* strains and plasmids used as donors for their production are provided in Table 3.

5.3 *Leishmania* Cell

Provided herein is a *Leishmania* host cell in which a gene encoding an enzyme that catalyzes the formation of O-linked GlcNAc prior to genetic engineering has been functionally inactivated.

5.3.1 Genetically Engineered *Leishmania* Cell

In certain embodiments, the *Leishmania* cells used herein are genetically engineered such that the formation of an O-linked GlcNAc on a polypeptide in the *Leishmania* cell is reduced or eliminated. In certain embodiments, the formation of O-linked GlcNAc in the *Leishmania* cell prior to genetic engineering is catalyzed by at least one N-acetylglucosamine (GlcNAc)-transferase. In certain embodiments, the gene encoding the at least one GlcNAc-transferase is functionally inactivated.

In certain embodiments, the gene encoding the at least one GlcNAc-transferase in the *Leishmania* Cell is downregulated. In certain embodiments, the gene encoding the at least one GlcNAc-transferase in the *Leishmania* Cell is overexpressed.

In certain embodiments, the *Leishmania* cells provided herein comprise at least one gene deletion. In certain embodiments, the gene encoding the at least one GlcNAc-transferase is deleted.

In certain embodiments, the gene encoding the at least one GlcNAc-transferase is mutated.

In certain embodiments, additional modifications may be introduced (e.g., using recombinant techniques) into the *Leishmania* cell described herein.

In certain embodiments, in the genetically engineered *Leishmania* cells, the formation of the O-linked GlcNAc is reduced by at least 5%, 7%, 10%, 12%, 15%, 18%, 20%, 25%, 30%, 35%, 40%, 45%, 50%, 55%, 60%, 65%, 70%, 75%, 80%, 85%, 90%, 95%, or 100% from the formation of the O-linked GlcNAc in a reference *Leishmania* cell. In certain embodiments, in the genetically engineered *Leishmania* cells, the formation of the O-linked GlcNAc is reduced by 5%, 7%, 10%, 12%, 15%, 18%, 20%, 25%, 30%, 35%, 40%, 45%, 50%, 55%, 60%, 65%, 70%, 75%, 80%, 85%, 90%, 95%, or 100% from the formation of the O-linked GlcNAc in a reference *Leishmania* cell. In certain embodiments, the reference *Leishmania* cell is wild-type. In certain embodiments, the reference *Leishmania* cell is genetically engineered differently as the genetically engineered *Leishmania* cells described herein. In certain embodiments, some of the engineering of the reference *Leishmania* cell may be the same of the engineering of the genetically engineered *Leishmania* cells described herein, for example the deletion of one or more enzymes that catalyze the formation of O-linked GlcNAc. In certain embodiments, the reference *Leishmania* cell may comprise a recombinant nucleic acid encoding a heterologous glycosyltransferase, for example the *Leishmania* cells described in International Publication No. WO2019/002512 A2, incorporated by reference in its entirety herein. In certain embodiments, the formation of the O-linked GlcNAc is reduced by at least 5%, 7%, 10%, 12%, 15%, 18%, 20%, 25%, 30%, 35%, 40%, 45%, 50%, 55%, 60%, 65%, 70%, 75%, 80%, 85%, 90%, 95%, or 100% from the formation of the O-linked GlcNAc in a wild-type *Leishmania* cell. In certain embodiments, the formation of the O-linked GlcNAc is reduced by 5%, 7%, 10%, 12%, 15%, 18%, 20%, 25%, 30%, 35%, 40%, 45%, 50%, 55%, 60%, 65%, 70%, 75%, 80%, 85%, 90%, 95%, or 100% from the formation of the O-linked GlcNAc in a wild-type *Leishmania* cell. In certain embodiments, the formation of the O-linked GlcNAc is reduced by at least 5%, 7%, 10%, 12%, 15%, 18%, 20%, 25%, 30%, 35%, 40%, 45%, 50%, 55%, 60%, 65%, 70%, 75%, 80%, 85%, 90%, 95%, or 100% from the formation of the O-linked GlcNAc in a *Leishmania* cell that comprises a recombinant nucleic acid encoding a heterologous glycosyltransferase. In certain embodiments, the formation of the O-linked GlcNAc is reduced by 5%, 7%, 10%, 12%, 15%, 18%, 20%, 25%, 30%, 35%, 40%, 45%, 50%, 55%, 60%, 65%, 70%, 75%, 80%, 85%, 90%, 95%, or 100% from the formation of the O-linked GlcNAc in a *Leishmania* cell that comprises a recombinant nucleic acid encoding a heterologous glycosyltransferase.

In certain embodiments, the growth rate of the genetically engineered *Leishmania* cells described herein is at least 60%, 65%, 70%, 75%, 80%, 85%, 90%, 95%, or 100% of the growth rate of a reference *Leishmania* cell. In certain embodiments, the growth rate of the *Leishmania* cell is 60%, 65%, 70%, 75%, 80%, 85%, 90%, 95%, or 100% of the growth rate of a reference *Leishmania* cell. In certain embodiments, the reference *Leishmania* cell is wild-type. In certain embodiments, the reference *Leishmania* cell is genetically engineered differently as the genetically engineered *Leishmania* cells described herein. In certain embodiments, some of the engineering of the reference *Leishmania* cell may be the same of the engineering of the genetically engineered *Leishmania* cells described herein, for example the deletion of one or more enzymes that catalyze the formation of O-linked GlcNAc. In certain embodiments, the growth rate of the *Leishmania* cell is at least 60%, 65%, 70%, 75%, 80%, 85%, 90%, 95%, or 100% of the growth rate of a wild-type *Leishmania* cell. In certain embodiments, the growth rate of the *Leishmania* cell is 60%, 65%, 70%, 75%, 80%, 85%, 90%, 95%, or 100% of the growth rate of a wild-type *Leishmania* cell.

5.3.2 *Leishmania* and Kinetoplastida Strains

In certain embodiments, a cell with reduced or eliminated ability to form O-linked GlcNAc on a polypeptide is a *Leishmania* cell. In certain embodiments, the *Leishmania* cell is a *Leishmania tarentolae* cell. In certain embodiments, the *Leishmania* cell is a *Leishmania aethiopica* cell. In certain embodiments, the *Leishmania* cell is part of the *Leishmania aethiopica* species complex. In certain embodiments, the *Leishmania* cell is a *Leishmania aristidesi* cell. In certain embodiments, the *Leishmania* cell is a *Leishmania deanei* cell. In certain embodiments, the *Leishmania* cell is part of the *Leishmania donovani* species complex. In certain embodiments, the *Leishmania* cell is a *Leishmania donovani* cell. In certain embodiments, the *Leishmania* cell is a *Leishmania chagasi* cell. In certain embodiments, the *Leishmania* cell is a *Leishmania infantum* cell. In certain embodiments, the *Leishmania* cell is a *Leishmania hertigi* cell. In certain embodiments, the *Leishmania* cell is part of the *Leishmania major* species complex. In certain embodiments, the *Leishmania* cell is a *Leishmania major* cell. In certain embodiments, the *Leishmania* cell is a *Leishmania martiniquensis* cell. In certain embodiments, the *Leishmania* cell is part of the *Leishmania mexicana* species complex. In certain embodiments, the *Leishmania* cell is a *Leishmania mexicana* cell. In certain embodiments, the *Leishmania* cell is a *Leishmania pifanoi* cell. In certain embodiments, the *Leishmania* cell is part of the *Leishmania tropica* species complex. In certain embodiments, the *Leishmania* cell is a *Leishmania tropica* cell.

In certain embodiments, a cell with reduced or eliminated ability to form O-linked GlcNAc on a polypeptide belongs to the bodonidae family of kinetoplasts. In a specific embodiment, the host cell is a Bodo saltans cell. In certain embodiments, the host cell belongs to the ichthyobodonidae family of kinetoplasts. In certain embodiments, the host cell belongs to the trypanosomatidae family of kinetoplasts. In certain embodiments, the host cell belongs to the blastocrithidia family of trypanosomatidae. In certain embodiments, the host cell belongs to the blechomonas family of trypanosomatidae. In certain embodiments, the host cell belongs to the herpetomonas family of trypanosomatidae. In certain embodiments, the host cell belongs to the jaenimonas family of trypanosomatidae. In certain embodiments, the host cell belongs to the lafontella family of trypanosomatidae. In certain embodiments, the host cell belongs to the leishmaniinae family of trypanosomatidae. In certain embodiments, the host cell belongs to the novymonas family of trypanosomatidae. In certain embodiments, the host cell belongs to the paratrypanosoma family of trypanosomatidae. In certain embodiments, the host cell belongs to the phytomonas family of trypanosomatidae. In certain embodiments, the host cell belongs to the sergeia family of trypanosomatidae. In certain embodiments, the host cell belongs to the strigomonadinae family of trypanosomatidae. In certain embodiments, the host cell belongs to the *trypanosoma* family of trypanosomatidae. In certain embodiments, the host cell belongs to the wallacemonas family of trypanosomatidae. In certain embodiments, the host cell belongs to the blastocrithidia family of trypanosomatidae.

5.4 Uses of the *Leishmania* Cell as Expression Systems

In certain embodiments, a *Leishmania* cell with reduced or eliminated ability to form O-linked GlcNAc on a polypeptide (as described in Section 5.3) may be used as an expression system for the polypeptide. In certain embodiments, the polypeptide may be a heterologous, non-*Leishmania* protein, such as a therapeutic protein (e.g., an antibody or an antibody format).

5.4.1 Compositions Comprising Host Cells

In one aspect, provided herein are compositions comprising the host cells described herein, for example, compositions comprising the *Leishmania* cells described herein. Such compositions can be used in methods for generating a target polypeptide as described in Section 5.3. In certain embodiments, the compositions comprising host cells can be cultured under conditions suitable for the production of polypeptides. Subsequently, the polypeptides can be isolated from said compositions comprising host cells using methods known in the art.

The compositions comprising the host cells provided herein can comprise additional components suitable for maintenance and survival of the host cells described herein, and can additionally comprise additional components required or beneficial to the production of polypeptides by the host cells, e.g., inducers for inducible promoters, such as arabinose, IPTG.

5.4.2 Methods of Target Polypeptide Production

In one aspect, provided herein are methods for making a target polypeptide. In one embodiment, provided herein is a method of producing a target polypeptide in vivo, using a host cell described herein. In a specific embodiment, provided herein is a method for producing a target polypeptide, said method comprising (i) culturing a host cell provided herein under conditions suitable for polypeptide production and (ii) isolating said target polypeptide. In a specific embodiment, the host cell comprises (a) a recombinant nucleic acid encoding a target polypeptide; and (b) a recombinant nucleic acid encoding a heterologous glycosyltransferase. In certain embodiments, the heterologous glycosyltransferase is an N-acetyl glucosamine transferase; or a heterologous galactosyltransferase; or a heterologous sialyltransferase. In certain embodiments, the host cell is a *Leishmania* cell. In certain embodiments, the *Leishmania* cell comprises one or more heterologous glycosyltransferases. In certain embodiments, the *Leishmania* cell comprises one or more N-acetyl glucosamine transferases; and/or one or more heterologous galactosyltransferases; and/or one or more heterologous sialyltransferases.

In certain embodiments, the target polypeptide produced by the host cells provided is a therapeutic polypeptide, i.e., a polypeptide used in the treatment of a disease or disorder. For example, the target polypeptide produced by the host cells provided herein can be an enzyme, a cytokine, or an antibody. A list of non-limiting exemplary target polypeptides is provided in Section 5.5.

5.5 Target Polypeptide

In certain embodiments, the target polypeptide produced by the host cells provided is a therapeutic polypeptide, i.e., a polypeptide used in the treatment of a disease or disorder. For example, the target polypeptide produced by the host cells provided herein can be an enzyme, a cytokine, or an antibody. In certain embodiments, the target the polypeptide is selected from the group consisting of adalimumab, rituximab and erythropoietin (EPO).

Any polypeptide (or peptide/polypeptide corresponding to the polypeptide) known in the art can be used as a target polypeptide in accordance with the methods described herein. One of skill in the art will readily appreciate that the nucleic acid sequence of a known polypeptide, as well as a newly identified polypeptide, can easily be deduced using methods known in the art, and thus it would be well within the capacity of one of skill in the art to introduce a nucleic acid that encodes any polypeptide of interest into a host cell provided herein (e.g., via an expression vector, e.g., a plasmid, e.g., a site specific integration by homologous recombination).

In certain embodiments, the target polypeptide is glycosylated, e.g., sialylated. One of skill in the art will further recognize that the target polypeptides may be glycosylated using the methods described herein, e.g., either in vivo using a host cell provided herein or in vitro, possess therapeutic benefit (e.g., due to improved pharmacokinetics) and thus can be used in the treatment of subjects having diseases/disorders that will benefit from treatment with the glycosylated (e.g., polysialylated) target polypeptides.

In certain embodiments, the target polypeptide comprises the amino acid sequence of human Interferon-α (INF-α), Interferon-β (INF-β), Interferon-γ (INF-γ), Interleukin-2 (IL2), Chimeric diphteria toxin-IL-2 (Denileukin diftitox), Interleukin-1 (IL1), IL1B, IL3, IL4, IL11, IL21, IL22, IL1 receptor antagonist (anakinra), Tumor necrosis factor alpha (TNF-α), Insulin, Pramlintide, Growth hormone (GH), Insulin-like growth factor (IGF1), Human parathyroid hormone, Calcitonin, Glucagon-like peptide-1 agonist (GLP-1), Glucagon, Growth hormone-releasing hormone (GHRH), Secretin, Thyroid stimulating hormone (TSH), Human bone morphogenic polypeptide 2 (hBMP2), Human bone morphogenic protein 7 (hBMP7), Gonadotropin releasing hormone (GnRH), Keratinocyte growth factor (KGF), Platelet-derived growth factor (PDGF), Fibroblast growth factor 7 (FGF7), Fibroblast growth factor 20 (FGF20), Fibroblast growth factor 21 (FGF21), Epidermal growth factor (EGF), Vascular endothelial growth factor (VEGF), Neurotrophin-3, Human follicle-stimulating hormone (FSH), Human chorionic gonadotropin (HCG), Lutropin-α, Erythropoietin, Granulocyte colony-stimulating factor (G-CSF), Granulocyte-macrophage colony-stimulating factor (GM-CSF), the extracellular domain of CTLA4 (e.g., an FC-fusion), or the extracellular domain of TNF receptor (e.g., an FC-fusion). In a specific embodiment, the target polypeptide used in accordance with the methods and host cells described herein is an enzyme or an inhibitor. Exemplary enzymes and inhibitors that can be used as a target polypeptide include, without limitation, Factor VII, Factor VIII, Factor IX, Factor X, Factor XIII, Factor VIIa, Antithrombin III (AT-III), Polypeptide C, Tissue plasminogen activator (tPA) and tPA variants, Urokinase, Hirudin, Streptokinase, Glucocerebrosidase, Alglucosidase-α, Laronidase (α-L-iduronidase), Idursulphase (Iduronate-2-sulphatase), Galsulphase, Agalsidase-β (human α-galactosidase A), Botulinum toxin, Collagenase, Human DNAse-I, Hyaluronidase, Papain, L-Asparaginase, Uricase (Urate oxidase), glutamate carboxypeptidase (glucarpidase), al Protease inhibitor (al antitrypsin), Lactase, Pancreatic enzymes (lipase, amylase, protease), and Adenosine deaminase.

In a specific embodiment, the target polypeptide used in accordance with the methods and host cells described herein is a cytokine. Exemplary cytokines that can be used as a target polypeptide include, without limitation, Interferon-α (INF-α), Interferon-β (INF-β), Interferon-γ (INF-γ), Interleukin-2 (IL2), Chimeric diphteria toxin-IL-2 (Denileukin diftitox), Interleukin-1 (IL1), IL1B, IL3, IL4, IL11, IL21, IL22, IL1 receptor antagonist (anakinra), and Tumor necrosis factor alpha (TNF-α).

In a specific embodiment, the target polypeptide used in accordance with the methods and host cells described herein is a hormone or growth factor. Exemplary hormones and growth factors that can be used as a target polypeptide include, without limitation, Insulin, Pramlintide, Growth hormone (GH), Insulin-like growth factor (IGF1), Human parathyroid hormone, Calcitonin, Glucagon-like peptide-1 agonist (GLP-1), Glucagon, Growth hormone-releasing hormone (GHRH), Secretin, Thyroid stimulating hormone (TSH), Human bone morphogenic polypeptide 2 (hBMP2), Human bone morphogenic protein 7 (hBMP7), Gonadotropin releasing hormone (GnRH), Keratinocyte growth factor (KGF), Platelet-derived growth factor (PDGF), Fibroblast growth factor 7 (FGF7), Fibroblast growth factor 20 (FGF20), Fibroblast growth factor 21 (FGF21), Epidermal growth factor (EGF), Vascular endothelial growth factor (VEGF), Neurotrophin-3, Human follicle-stimulating hormone (FSH), Human chorionic gonadotropin (HCG), Lutropin-α, Erythropoietin, Granulocyte colony-stimulating factor (G-CSF), and Granulocyte-macrophage colony-stimulating factor (GM-CSF).

In a specific embodiment, the target polypeptide used in accordance with the methods and host cells described herein is a receptor. Exemplary receptors that can be used as a target polypeptide include, without limitation, the extracellular domain of human CTLA4 (e.g., fused to an Fc) and the soluble TNF receptor (e.g., fused to an Fc).

In other embodiments, the target polypeptide is a therapeutic polypeptide. In other embodiments, the target polypeptide is an approved biologic drug. In another embodiment, the therapeutic polypeptide comprises the amino acid sequence of Abatacept (e.g., Orencia), Aflibercept (e.g., Eylea), Agalsidase beta (e.g., Fabrazyme), Albiglutide (e.g., Eperzan), Aldesleukin (e.g., Proleukin), Alefacept (e.g., Amevive), Alglucerase (e.g., Ceredase), Alglucosidase alfa (e.g., LUMIZYME), Aliskiren (e.g., Tekturna), Alpha-1-polypeptidease inhibitor (e.g., Aralast), Alteplase (e.g., Activase), Anakinra (e.g., Kineret), Anistreplase (e.g., Eminase), Anthrax immune globulin human (e.g., ANTHRASIL), Antihemophilic Factor (e.g., Advate), Anti-inhibitor coagulant complex (e.g., Feiba Nf), Antithrombin Alfa, Antithrombin III human, Antithymocyte globulin (e.g., Antithymocyte globulin), Anti-thymocyte Globulin (Equine) (e.g., ATGAM), Anti-thymocyte Globulin (Rabbit) (e.g., ATG-Fresenius), Aprotinin (e.g., Trasylol), Asfotase Alfa, Asparaginase (e.g., Elspar), Asparaginase *Erwinia chrysanthemi* (e.g., Erwinaze), Becaplermin (e.g., REGRANEX), Belatacept (e.g., Nulojix), Beractant, Bivalirudin (e.g., Angiomax), Botulinum Toxin Type A (e.g., BOTOXÊ), Botulinum Toxin Type B (e.g., Myobloc), Brentuximab vedotin (e.g., Adcetris), Buserelin (e.g., Suprecur), C1 Esterase Inhibitor (Human), C1 Esterase Inhibitor (Recombinant) (e.g., Ruconest), Certolizumab pegol (e.g., Cimzia), Choriogonadotropin alfa (e.g., Choriogonadotropin alfa), Chorionic Gonadotropin (Human) (e.g., Ovidrel), Chorionic Gonadotropin (Recombinant) (e.g., Ovitrelle), Coagulation factor ix (e.g., Alprolix), Coagulation factor VIIa (e.g., NovoSeven), Coagulation factor X human (e.g., Coagadex), Coagulation Factor XIII A-Subunit (Recombinant), Collagenase (e.g., Cordase), Conestat alfa, Corticotropin (e.g., H. P. Acthar), Cosyntropin (e.g., Cortrosyn), Darbepoetin alfa (e.g., Aranesp), Defibrotide (e.g., Noravid), Denileukin diftitox (e.g., Ontak), Desirudin, Digoxin Immune Fab (Ovine) (e.g., DIGIBIND), Dornase alfa (e.g., Pulmozyme), Drotrecogin alfa (e.g., Xigris), Dulaglutide, Efmoroctocog alfa (e.g., ELOCTA), Elosulfase alfa, Enfuvirtide (e.g., FUZEON), Epoetin alfa (e.g., Binocrit), Epoetin zeta (e.g., Retacrit), Eptifibatide (e.g., INTEGRILIN), Etanercept (e.g., Enbrel), Exenatide (e.g., Byetta), Factor IX Complex (Human) (e.g., AlphaNine), Fibrinolysin aka plasmin (e.g., Elase), Filgrastim (e.g., N. A.), Filgrastim-sndz, Follitropin alfa (e.g., Gonal-F), Follitropin beta (e.g., Follistim AQ), Galsulfase (e.g., Naglazyme), Gastric intrinsic factor, Gemtuzumab ozogamicin (e.g., Mylotarg), Glatiramer acetate (e.g., Copaxone), Glucagon recombinant (e.g., GlucaGen), Glucarpidase (e.g., Voraxaze), Gramicidin D (e.g., Neosporin), Hepatitis B immune globulin, Human calcitonin, Human *Clostridium tetani* toxoid immune globulin, Human rabies virus immune globulin (e.g., Hyperab Rabies Immune Globulin Human), Human Rho (D) immune globulin (e.g., Hyp Rho D Inj 16.5%), Human Serum Albumin (e.g., Albuminar), Human Varicella-Zoster Immune Globulin (e.g., Varizig), Hyaluronidase (e.g., HYLENEX), Hyaluronidase (Human Recombinant), Ibritumomab tiuxetan (e.g., Zevalin), Idursulfase (e.g., Elaprase), Imiglucerase (e.g., Cerezyme), Immune Globulin Human, Insulin aspart (e.g., NovoLog), Insulin Beef, Insulin Degludec (e.g., Tresiba), Insulin detemir (e.g., LEVEMIR), Insulin Glargine (e.g., Lantus), Insulin glulisine (e.g., APIDRA), Insulin Lispro (e.g., Humalog), Insulin Pork (e.g., Iletin II), Insulin Regular (e.g., Humulin R), Insulin, porcine (e.g., vetsulin), Insulin, isophane (e.g., Novolin N), Interferon Alfa-2a, Recombinant (e.g., Roferon A), Interferon alfa-2b (e.g., INTRON A), Interferon alfacon-1 (e.g., INFERGEN), Interferon alfa-nl (e.g., Wellferon), Interferon alfa-n3 (e.g., Alferon), Interferon beta-1a (e.g., Avonex), Interferon beta-1b (e.g., Betaseron), Interferon gamma-1b (e.g., Actimmune), Intravenous Immunoglobulin (e.g., Civacir), Laronidase (e.g., Aldurazyme), Lenograstim (e.g., Granocyte), Lepirudin (e.g., Refludan), Leuprolide (e.g., Eligard), Liraglutide (e.g., Saxenda), Lucinactant (e.g., Surfaxin), Lutropin alfa (e.g., Luveris), Mecasermin (e.g., N. A.), Menotropins (e.g., Menopur), Methoxy polyethylene glycol-epoetin beta (e.g., Mircera), Metreleptin (e.g., Myalept), Natural alpha interferon OR multiferon (e.g., Intron/Roferon-A), Nesiritide (e.g., NATRECOR), Ocriplasmin (e.g., Jetrea), Oprelvekin (e.g., Neumega), OspA lipopolypeptide (e.g., Lymerix), Oxytocin (e.g., Pitocin), Palifermin (e.g., Kepivance), Pancrelipase (e.g., Pancrecarb), Pegademase bovine (e.g., Adagen), Pegaspargase (e.g., Oncaspar), Pegfilgrastim (e.g., Neulasta), Peginterferon alfa-2a (e.g., Pegasys), Peginterferon alfa-2b (e.g., PEG-Intron), Peginterferon beta-1a (e.g., Plegridy), Pegloticase (e.g., (Krystexxa)), Pegvisomant (e.g., SOMAVERT), Poractant alfa (e.g., Curosurf), Pramlintide (e.g., Symlin), Preotact (e.g., PreotactÊ), Protamine sulfate (e.g., Protamine Sulfate Injection, USP), Polypeptide S human (e.g., Polypeptide S human), Prothrombin (e.g., Feiba Nf), Prothrombin complex (e.g., Cofact), Prothrombin complex concentrate (e.g., Kcentra), Rasburicase (e.g., Elitek), Reteplase (e.g., Retavase), Rilonacept (e.g., Arcalyst), Romiplostim (e.g., Nplate), Sacrosidase (e.g., Sucraid), Salmon Calcitonin (e.g., Calcimar), Sargramostim (e.g., Leucomax), Satumomab Pendetide (e.g., OncoScint), Sebelipase alfa (e.g., Kanuma), Secretin (e.g., SecreFlo), Sermorelin (e.g., Sermorelin acetate), Serum albumin (e.g., Albunex), Serum albumin iodonated (e.g., Megatope), Simoctocog Alfa (e.g., Nuwiq), Sipuleucel-T (e.g., Provenge), Somatotropin Recombinant (e.g., NutropinAQ), Somatropin recombinant (e.g., BioTropin), Streptokinase (e.g., Streptase), Susoctocog alfa (e.g., Obizur), Taliglucerase alfa (e.g., Elelyso), Teduglutide (e.g., Gattex), Tenecteplase (e.g., TNKase), Teriparatide (e.g., Forteo), Tesamorelin (e.g., Egrifta), Thrombomodulin Alfa (e.g., Recomodulin), Thymalfasin (e.g., Zadaxin), Thyroglobulin, Thyrotropin Alfa (e.g., Thyrogen), Tuberculin Purified Polypeptide Derivative (e.g., Aplisol), Turoctocog alfa (e.g., Zonovate), Urofollitropin (e.g., BRAVELLE), Urokinase (e.g., Kinlytic), Vasopressin (e.g., Pitressin), Velaglucerase alfa (e.g., Vpriv), Abciximab (e.g., ReoPro), Adalimumab (e.g., Humira), Alemtuzumab (e.g., CAMPATH), Alirocumab (e.g., Praluent), Arcitumomab (e.g., CEA-Scan), Atezolizumab (e.g., Tecentriq), Basiliximab (e.g., Simulect), Belimumab (e.g., Benlysta), Bevacizumab (e.g., Avastin), Blinatumomab (e.g., Blincyto), Brodalumab (e.g., Siliq), Canakinumab (e.g., ILARISE), Canakinumab (e.g., Ilaris), Capromab (e.g., ProstaScint), Cetuximab (e.g., Erbitux), Daclizumab (e.g., Zenapax), Daratumumab (e.g., DARZALEX), Denosumab (e.g., Xgeva), Dinutuximab (e.g., unituxin), Eculizumab (e.g., Soliris), Efalizumab (e.g., RAPTIVA), Elotuzumab (e.g., EMPLICITI), Evolocumab (e.g., Repatha), Golimumab (e.g., Simponi Injection), Ibritumomab (e.g., Zevalin), Idarucizumab (e.g., Praxbind), Infliximab (e.g., REMICADE), Ipilimumab (e.g., YERVOY), Ixekizumab (e.g., Taltz), Mepolizumab (e.g., Nucala), Muromonab (e.g., ORTHOCLONE OKT3), Natalizumab (e.g., Tysabri), Necitumumab (e.g., Portrazza), Nivolumab (e.g., Opdivo), Obiltoxaximab (e.g., Anthim), Obinutuzumab (e.g., Gazyva), Ofatumumab (e.g., Arzerra), Omalizumab (e.g., Xolair), Palivizumab (e.g., Synagis), Panitumumab (e.g., Vectibix), Pembrolizumab (e.g., Keytruda), Pertuzumab (e.g., Perjeta), Ramucirumab (e.g., Cyramza), Ranibizumab (e.g., Lucentis), Raxibacumab (e.g., RAXIBACUMAB), Rituximab (e.g., Rituxan), Secukinumab (e.g., Cosentyx), Siltuximab (e.g., Sylvant), Tocilizumab (e.g., ACTEMRA), Tositumomab (e.g., Bexxar), Trastuzumab (e.g., Herceptin), Ustekinumab (e.g., Stelara), or Vedolizumab (e.g., Entyvio).

In other embodiments, the target polypeptide is an antibody. In further embodiments, the antibody has the amino acid sequence of adalimumab (Humira); Remicade (Infliximab); ReoPro (Abciximab); Rituxan (Rituximab); Simulect (Basiliximab); Synagis (Palivizumab); Herceptin (Trastuzumab); Mylotarg (Gemtuzumab ozogamicin); Campath (Alemtuzumab); Zevalin (Ibritumomab tiuxetan); Xolair (Omalizumab); Bexxar (Tositumomab-I-131); Erbitux (Cetuximab); Avastin (Bevacizumab); Tysabri (Natalizumab); Actemra (Tocilizumab); Vectibix (Panitumumab); Lucentis (Ranibizumab); Soliris (Eculizumab); Cimzia (Certolizumab pegol); Simponi (Golimumab); Ilaris (Canakinumab); Stelara (Ustekinumab); Arzerra (Ofatumumab); Prolia (Denosumab); Numax (Motavizumab); ABThrax (Raxibacumab); Benlysta (Belimumab); Yervoy (Ipilimumab); Adcetris (Brentuximab Vedotin); Perjeta (Pertuzumab); Kadcyla (Ado-trastuzumab emtansine); or Gazyva (Obinutuzumab).

In other embodiments, the antibody is a full length antibody, an Fab, an $F(ab')_2$, an Scfv, or a sdAb. In other embodiments, the target polypeptide comprises the amino acid sequence of an enzyme or an inhibitor thereof. In another embodiment, the target polypeptide comprises the amino acid sequence of Factor VII, Factor VIII, Factor IX, Factor X, Factor XIII, Factor VIIa, Antithrombin III (AT-III), Polypeptide C, Tissue plasminogen activator (tPA) and tPA variants, Urokinase, Hirudin, Streptokinase, Glucocerebrosidase, Alglucosidase-α, Laronidase (α-L-iduronidase), Idursulphase (Iduronate-2-sulphatase), Galsulphase, Agalsidase-β (human α-galactosidase A), Botulinum toxin, Collagenase, Human DNAse-I, Hyaluronidase, Papain, L-Asparaginase, Uricase (Urate oxidase), glutamate carboxypeptidase (glucarpidase), α1 Protease inhibitor (α1 antitrypsin), Lactase, Pancreatic enzymes (lipase, amylase, protease), and Adenosine deaminase.

In a specific embodiment, the target polypeptide used in accordance with the methods and host cells described herein is a receptor. Exemplary receptors that can be used as a target polypeptide include, without limitation, the extracellular domain of human CTLA4 (e.g., fused to an Fc) and the soluble TNF receptor (e.g., fused to an Fc).

In another embodiment, the target polypeptide is secreted into the culture media. In certain embodiments, the target polypeptide is purified from the culture media. In another embodiment, the target polypeptide is purified from the culture media via affinity purification or ion exchange chromatography. In another embodiment, the target polypeptide contains an FC domain and is affinity purified from the culture media via polypeptide-A. In another embodiment, the target polypeptide contains an affinity tag and is affinity purified.

In certain embodiments, the target polypeptide used in accordance with the methods and host cells described herein can be a full length polypeptide, a truncation, a polypeptide domain, a region, a motif or a peptide thereof.

In certain embodiments, the target polypeptide is an Fc-fusion polypeptide.

In certain embodiments, the target polypeptide is a biologic comprising an Fc domain of an IgG.

In certain embodiment, the target polypeptide could be modified. In another embodiment, the target polypeptide has been engineered to comprise a signal sequence from *Leishmania*. In other embodiments, the signal sequence is processed and removed from the target polypeptide. In another embodiment, the target polypeptide has been engineered to comprise one or more tag(s). In other embodiments, the tag is processed and removed from the target polypeptide.

5.5.1 Composition and/or Formulation Comprising the Polypeptide

In another aspect, provided herein are compositions (e.g., pharmaceutical compositions) comprising one or more of the target polypeptides described herein. The compositions described herein are useful in the treatment and/or prevention of diseases/disorders in subjects (e.g., human subjects) (see Section 5.5.2).

In certain embodiments, in addition to comprising a target polypeptide described herein, the compositions (e.g., pharmaceutical compositions) described herein comprise a pharmaceutically acceptable carrier. As used herein, the term "pharmaceutically acceptable" means approved by a regulatory agency of the Federal or a state government or listed in the U.S. Pharmacopeia or other generally recognized pharmacopeiae for use in animals, and more particularly in humans. The term "carrier," as used herein in the context of a pharmaceutically acceptable carrier, refers to a diluent, adjuvant, excipient, or vehicle with which the pharmaceutical composition is administered. Saline solutions and aqueous dextrose and glycerol solutions can also be employed as liquid carriers, particularly for injectable solutions. Suitable excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. Examples of suitable pharmaceutical carriers are described in "Remington's Pharmaceutical Sciences" by E. W. Martin.

In certain embodiments, the compositions described herein are formulated to be suitable for the intended route of administration to a subject. For example, the compositions described herein may be formulated to be suitable for subcutaneous, parenteral, oral, intradermal, transdermal, colorectal, intraperitoneal, and rectal administration. In a specific embodiment, the pharmaceutical composition may be formulated for intravenous, oral, intraperitoneal, intranasal, intratracheal, subcutaneous, intramuscular, topical, intradermal, transdermal or pulmonary administration.

In certain embodiments, the compositions described herein additionally comprise one or more buffers, e.g., phosphate buffer and sucrose phosphate glutamate buffer. In other embodiments, the compositions described herein do not comprise buffers.

In certain embodiments, the compositions described herein additionally comprise one or more salts, e.g., sodium chloride, calcium chloride, sodium phosphate, monosodium glutamate, and aluminum salts (e.g., aluminum hydroxide, aluminum phosphate, alum (potassium aluminum sulfate), or a mixture of such aluminum salts). In other embodiments, the compositions described herein do not comprise salts.

The compositions described herein can be included in a kit, container, pack, or dispenser together with instructions for administration.

The compositions described herein can be stored before use, e.g., the compositions can be stored frozen (e.g., at about −20° C. or at about −70° C.); stored in refrigerated conditions (e.g., at about 4° C.); or stored at room temperature.

5.5.2 Prophylactic and Therapeutic Uses

In one aspect, provided herein are methods of preventing or treating a disease or disorder in a subject comprising administering to the subject a target polypeptide described herein or a composition thereof. Further provided herein are methods of preventing a disease or disorder in a subject comprising administering to the subject a target polypeptide described herein or a composition thereof.

In one aspect, provided herein are methods of treating a disease or disorder in a subject comprising administering to the subject a target polypeptide described herein or a composition thereof. In another aspect, provided herein are methods of preventing a disease or disorder in a subject comprising administering to the subject a target polypeptide described herein or a composition thereof. In a specific embodiment, provided herein is a method for treating or preventing a disease or disorder in a subject comprising administering to the subject a polysialylated target polypeptide produced according to the methods described herein.

In certain embodiments, the disease or disorder may be caused by the presence of a defective version of a target polypeptide in a subject, the absence of a target polypeptide in a subject, diminished expression of a target polypeptide in a subject can be treated or prevented using the target polypeptides produced using the methods described herein. In certain embodiments, the diseases or disorder may be mediated by a receptor that is bound by a target polypeptide produced using the methods described herein, or mediated by a ligand that is bound by a target polypeptide produced using the methods described herein (e.g., where the target polypeptide is a receptor for the ligand).

In certain embodiments, the methods of preventing or treating a disease or disorder in a subject comprise administering to the subject an effective amount of a target polypeptide described herein or a composition thereof. In certain embodiments, the effective amount is the amount of a therapy which has a prophylactic and/or therapeutic effect(s). In certain embodiments, an "effective amount" refers to the amount of a therapy which is sufficient to achieve one, two, three, four, or more of the following effects: (i) reduce or ameliorate the severity of a disease/disorder or symptom associated therewith; (ii) reduce the duration of a disease/disorder or symptom associated therewith; (iii) prevent the progression of a disease/disorder or symptom associated therewith; (iv) cause regression of a disease/disorder or symptom associated therewith; (v) prevent the development or onset of a disease/disorder, or symptom associated therewith; (vi) prevent the recurrence of a disease/disorder or symptom associated therewith; (vii) reduce organ failure associated with a disease/disorder; (viii) reduce hospitalization of a subject having a disease/disorder; (ix) reduce hospitalization length of a subject having a disease/disorder; (x) increase the survival of a subject with a disease/disorder; (xi) eliminate a disease/disorder in a subject; and/or (xii) enhance or improve the prophylactic or therapeutic effect(s) of another therapy.

5.6 Assay

5.6.1 Strains, Growth and Genetic Methods

Provided herein are methods for culturing host cells.

Host cells are cultured using any of the standard culturing techniques known in the art. For example, cells are routinely grown in rich media like Brain Heart Infusion, Trypticase Soy Broth or Yeast Extract, all containing 5 µg/ml Hemin. Additionally, incubation is done at 26° C. in the dark as static or shaking cultures for 2-3d. In some embodiments, cultures of recombinant cell lines contain the appropriate selective agents. In some embodiments, cultures contain Biopterin at a final concentration of 10 µM to support growth.

A non-limiting list of selective agents is provided in Table 2.

TABLE 2

Selective agents used during transfection (50% concentration for preselection and 100% concentration for main selection) and standard culturing of *L. tarentolae*. Double amounts of the selective agents could be used if higher selection pressure was intended.

| Selective agent | Resistance conferring gene | Concentration (100%) | Concentration (50%) |
|---|---|---|---|
| | | main selection/standard culturing | preselection |
| Nourseothricin | sat | 50 µg/ml | 25 µg/ml |
| Geneticin | neo | 50 µg/ml | 25 µg/ml |
| Paromomycin | neo | 300 µg/ml | 150 µg/ml |
| Zeocin | ble | 150 µg/ml | 75 µg/ml |
| Hygromycin | hyg | 50 µg/ml | 25 µg/ml |
| Blasticidin | bsd | 5 µg/ml | 2.5 µg/ml |
| Puromycin | pac | 5 µg/ml | 2.5 µg/ml |

TABLE 3

Summary of strains presented in the examples and plasmids used as donors for their production. Some of the strains were produced by several rounds of transfection building on top of each other.

| Strain | Strain number | Plasmids for Cas9 expression | Plasmids for OGNT KO/OE | Plasmids for GT and target protein expression |
|---|---|---|---|---|
| LMSAP-rhEPO-Strep | St11521 | | | pLMTB4239 |
| LMSAP-rhEPO-Strep | St12274 | — | — | pLMTB4239 |
| LMSAP-rhEPO-Strep Cas9-(hyg, integrated) | St17785 | pLMTB8777 | | pLMTB4239 |
| Triple OGNT-1/2/L KO LMSAP-rhEPO-Strep | St17917 | pLMTB8777 | pLMTB7805, 7807, 7811, 7812 | pLMTB4239 |
| Triple OGNT-1/2/L KO LMSAP-rhEPO-Strep Monoclone of St17917 | St18143 | pLMTB8777 | pLMTB7805, 7807, 7811, 7812 | pLMTB4239 |
| LMSAP-rhEPO-Strep G0-N N-glycan cell line | St11895 | | | pLMTB4239, 4123 |
| Adalimumab | St15449 | — | — | pLMTB7115 |
| Rituximab | St12427 | — | — | pLMTB5026 |
| G0 N-glycan cell line | St15673 | — | — | pLMTB6944, 6952, 6815, 6819, 6848, 6852, 7186, 6961 |
| Adalimumab G0 N-glycan cell line | St15882 | — | — | pLMTB7115, 6944, 6952, 6815, 6819, 6848, 6852, 7186, 6961 |
| G2 N-glycan cell line | St15257 | — | — | pLMTB6807, 6848, 6852, 6855, 6952, 6958, 6811, 6860, 6906, 6861 |
| Adalimumab G2 N-glycan cell line | St15451 | — | — | pLMTB7115, 6807, 6848, 6852, 6855, 6952, 6958, 6811, 6860, 6906, 6861 |
| Cas9 (hyg, episomal) | St15392 | pLMTB7101 | — | |
| Cas9 (hyg, episomal) Adalimumab | St16568/ St16569 | pLMTB7101 | — | pLMTB7115 |
| Cas9 (ble, episomal) Adalimumab | St16872 | pLMTB7100 | — | pLMTB7115 |

TABLE 3-continued

Summary of strains presented in the examples and plasmids used as donors for their production. Some of the strains were produced by several rounds of transfection building on top of each other.

| Strain | Strain number | Plasmids for Cas9 expression | Plasmids for OGNT KO/OE | Plasmids for GT and target protein expression |
|---|---|---|---|---|
| Cas9 (neo, episomal) Adalimumab | St16873 | pLMTB7102 | — | pLMTB7115 |
| Cas9 (neo, episomal) Adalimumab G0 N-glycan cell line | St17607 | pLMTB8640, 7102, 8225 | — | pLMTB7115, 56944, 6952, 6815, 6819, 6848, 6852, 7186, 6961 |
| Cas9 (neo, episomal) Adalimumab G2 N-glycan cell line | St17124 | pLMTB7100 | — | pLMTB7115, 6807, 6848, 6852, 6855, 6952, 6958, 6811, 6860, 6906, 6861 |
| Cas9 (hyg, episomal) LMSAP-rhEPO-Strep | St17785 | pLMTB8777 | | pLMTB4239 |
| OGNT-2 KO | St16248 | pLMTB7101 | pLMTB6460, 6471 | — |
| OGNT-1 KO | St16257 | pLMTB7101 | pLMTB6463,64 74 | — |
| OGNT-L KO | St16249 | pLMTB7101 | pLMTB6463, 6474 | — |
| OGNT-2 KO Adalimumab | St16478 | pLMTB7101 | pLMTB6460, 6471 | pLMTB7115 |
| OGNT-1 KO Adalimumab | St16700 | pLMTB7101 | pLMTB6463, 6474 | pLMTB7115 |
| OGNT-L KO Adalimumab | St16702 | pLMTB7101 | pLMTB6467, 6478 | pLMTB7115 |
| Double OGNT-1/L KO Adalimumab | St16704 | pLMTB7101 | pLMTB6474, 6466 | pLMTB7115 |
| Double OGNT-1/L KO (no IR) Adalimumab | St16770 | pLMTB7101 | pLMTB7811, 7812 | pLMTB7115 |
| Triple OGNT-1/2/L KO Adalimumab | St16636 | pLMTB7101 | pLMTB6460, 6471, 6474, 6466 | pLMTB7115 |
| Triple OGNT-1/2/L KO (no IR) Adalimumab | St17127 | pLMTB7100 | pLMTB7805, 7807, 7811, 7812 | pLMTB7115 |
| Triple OGNT-1/2/L KO Adalimumab G0-N-glycan cell line | St17863 | pLMTB8640, 7102, 8225 | pLMTB6467, 6475, 6470, 6459 | pLMTB7115, 6944, 6952, 6815, 6819, 6848, 6852, 7186, 6961 |
| Triple OGNT-1/2/L KO Adalimumab G2 N-glycan cell line | St17317/ St17318 | pLMTB7100 | pLMTB7805, 7807, 7811, 7812 | pLMTB7115, 6807, 6848, 6852, 6855, 6952, 6958, 6811, 6860, 6906, 6861 |
| OGNT-1/L:: G0 (heterozygous) Adalimumab G0 N-glycan cell line | St17846 | — | | pLMTB7115, 8223, 8381, 8301, 8234, 8629, 8238, 8287, 8383, 8384, 8229 |
| OGNT-2 OE Adalimumab | St15884 | — | pLMTB5932 | pLMTB7115 |
| OGNT-1 OE Adalimumab | St15885 | — | pLMTB5933 | pLMTB7115 |
| OGNT-L OE Adalimumab | St15886 | — | pLMTB5934 | pLMTB7115 |

TABLE 3-continued

Summary of strains presented in the examples and plasmids used as donors for their production. Some of the strains were produced by several rounds of transfection building on top of each other.

| Strain | Strain number | Plasmids for Cas9 expression | Plasmids for OGNT KO/OE | Plasmids for GT and target protein expression |
|---|---|---|---|---|
| OGNT-1 OE Adalimumab G0 N-glycan cell line | St16292 | | pLMTB5933 | pLMTB7115, 6944, 6952, 6815, 6819, 6848, 6852, 7186, 6961 |
| WT Man3 N-glycan cell line | St18344 | — | — | — |
| Triple OGNT-1/2/L KO (RNP) Man3 N-glycan cell line | St19955 | — | pLMTB9856, 9857, 7810, 7813 | — |
| Triple OGNT-1/2/L KO (RNP) Man3 N-glycan cell line | St20107 | — | pLMTB7805, 7807, 7811, 7812 | — |
| G0 (2x) N-glycan cell line | St19462 | — | — | pLMTB8389, 8310, 8234, 8311, 8235, 8631, 8632, 8313, 8236, 8314, 8633, 8297, 8392, 8223, 8564, 9070, 8568, 9072, 9080, 9082, 9083, 9077, 9305 |
| Triple OGNT-1/2/L KO (RNP) G0 (2x) N-glycan cell line | St19855 | — | pLMTB9852, 9853, 9854, 9855 | pLMTB838 9, 8310, 8234, 8311, 8235, 8631, 8632, 8313, 8236, 8314, 8633, 8297, 8392, 8223, 8564, 9070, 8568, 9072, 9080, 9082, 9083, 9077, 9305 |
| Triple OGNT-1/2/L KO (RNP) G0 (2x) N-glycan cell line | St20097 | — | pLMTB7805, 7807, 7811, 7812 | pLMTB8389, 8310, 8234, 8311, 8235, 8631, 8632, 8313, 8236, 8314, 8633, 8297, 8392, 8223, 8564, 9070, 8568, 9072, 9080, 9082, 9083, 9077, 9305 |
| Triple OGNT-1/2/L KO (RNP) Adalimumab G0 (2x) N-glycan cell line | St19915 | — | pLMTB9852, 9853, 9854, 9855 | pLMTB8389, 8310, 8234, 8311, 8235, 8631, 8632, 8313, 8236, 8314, 8633, 8297, 8392, 8223, 8564, 9070, 8568, 9072, 9080, 9082, 9083, 9077, 9305, 8803, 8698, 7084, 6681, 6683 |

TABLE 3-continued

Summary of strains presented in the examples and plasmids used as donors for their production. Some of the strains were produced by several rounds of transfection building on top of each other.

| Strain | Strain number | Plasmids for Cas9 expression | Plasmids for OGNT KO/OE | Plasmids for GT and target protein expression |
|---|---|---|---|---|
| Triple OGNT-1/2/L KO (RNP) G0 (3x) N-glycan cell line | St19931 | — | pLMTB9852, 9853, 9854, 9855 | pLMTB8389, 8310, 8234, 8311, 8235, 8631, 8632, 8313, 8236, 8314, 8633, 8297, 8392, 8223, 8564, 9070, 8568, 9072, 9080, 9082, 9083, 9077, 9305, 8223, 6948, 9839, 8608, 9840, 8582, 9841, 9836, 9832, 9838, 9303 |
| Triple OGNT-1/2/L KO (RNP) Adalimumab G0 (3x) N-glycan cell line | St19998 | — | pLMTB9852, 9853, 9854, 9855 | pLMTB8389, 8310, 8234, 8311, 8235, 8631, 8632, 8313, 8236, 8314, 8633, 8297, 8392, 8223, 8564, 9070, 8568, 9072, 9080, 9082, 9083, 9077, 9305, 8223, 6948, 9839, 8608, 9840, 8582, 9841, 9836, 9832, 9838, 9303, 8803, 8698, 7084, 6681, 6683 |
| Triple OGNT-1/2/L KO (RNP) G2 N-glycan cell line | St19885 | — | pLMTB9852, 9853, 9854, 9855 | pLMTB8389, 8310, 8234, 8311, 8235, 8631, 8632, 8313, 8236, 8314, 8633, 8297, 8392, 8223, 8564, 9070, 8568, 9072, 9080, 9082, 9083, 9077, 9305, 8391, 8831, 8832, 8834, 8836, 8281, 8821 |
| Triple OGNT-1/2/L KO (RNP) G2 N-glycan cell line | St20201 | — | pLMTB7805, 7807, 7811, 7812 | pLMTB8389, 8310, 8234, 8311, 8235, 8631, 8632, 8313, 8236, 8314, 8633, 8297, 8392, 8223, 8564, 9070, 8568, 9072, 9080, 9082, 9083, 9077, 9305, 10054, 9833, 8608, 9834, 8582, |

TABLE 3-continued

Summary of strains presented in the examples and plasmids used as donors for their production. Some of the strains were produced by several rounds of transfection building on top of each other.

| Strain | Strain number | Plasmids for Cas9 expression | Plasmids for OGNT KO/OE | Plasmids for GT and target protein expression |
|---|---|---|---|---|
| | | | | 9835, 9836, 9832, 10055, 8831, 8832, 8834, 8836, 8281, 8821 |

(i) Plasmids

Plasmids were derived from a pUC57 vector backbone for *E. coli* propagation and contained an ampicillin or kanamycin section marker. The expression cassettes are flanked by restriction sites suitable for excision. The composition of the cassettes depends on the intended use and is described in the respective methods. The genes of interest are included as ORFs that were codon usage optimized for *L. tarentolae*. Optimized sequences were manually curated for avoidance of restriction sites and deletion of repeats or homopolymer stretches. The plasmids were generated and sequenced by a gene synthesis provider. Plasmids and descriptions are found in the sequence listings.

For codon usage optimization, protein sequences were back-translated to nucleotide sequences using a custom Python3 script that stochastically selects codons based on the *L. tarentolae* codon usage frequency while excluding rare codons (frequency<10%). The codon usage has been calculated using cusp (Rice, et al. (2000) Trends in genetics: TIG 16 (6), pp. 276-277) on all annotated *L. tarentolae* nucleotide coding sequences.

(ii) DNA Construct Design for OGNT Deletion

For OGNT deletions, three different ways of construct composition were employed. In all cases, the integration constructs were split into two or more fragments of approximately 1000-2500 bp with overlapping regions of 200 bp within the constructs to allow homologous recombination of the complete construct into the *L. tarentolae* genome.

Replacement with a selection marker flanked by 5' and 3' untranslated regions providing it with defined splice leader acceptor and polyadenylation sequences (transcription by endogenous PolII). 1.) a 5' homology region for specific integration into the OGNT gene (ideally immediately after 5' UTR to remove the full coding sequence), 2.) an intergenic region providing a 5'UTR with splice leader acceptor sequence to the gene of interest, 3.) the gene of interest encoding for a selection marker as ORF that was codon usage optimized for *Leishmania* (either *L. major* or *L. tarentolae*), 4.) an intergenic region that provides a 3'UTR with polyadenylation site to the gene of interest, 5.) the 3' homology region for site specific recombination into the OGNT gene (see also FIG. 6, variant A).

Replacement with a selection marker without flanking untranslated regions (transcription by endogenous PolII). 1.) a 5' homology region for specific integration exactly after the 5' untranslated region of the OGNT gene, 2.) the gene of interest encoding for a selection marker as ORF that was codon usage optimized for *Leishmania* (either *L. major* or *L. tarentolae*), 3.) a 3' homology region for site specific recombination before the 3' UTR of the OGNT gene (see also FIG. 6, variant B).

Replacement with an expression cassette for glycoengineering (counterclockwise integration, transcription by PolI). 1.) a 5' homology region for specific integration into the OGNT gene, 2.) a promoter region for PolI transcription comprising terminal repeats and a 5' UTR with splice leader acceptor sequence for the gene of interest 3.) the gene of interest encoding for a glycosyltransferase or enzymes of a sugar biosynthesis pathway as ORF that was codon usage optimized for *Leishmania* (either *L. major* or *L. tarentolae*), 4.) an intergenic region providing a 3' polyadenylation site to the upstream gene and a splice leader acceptor site to the downstream gene, 5.) a selection marker as ORF that was codon usage optimized for *Leishmania* (either *L. major* or *L. tarentolae*), 4.) an intergenic region that provides a 3'UTR with polyadenylation site to the gene of interest, 5.) the 3' homology region for site specific recombination into the OGNT gene. Repetition of several elements 3 and 4 before the selection marker are possible.

(iii) DNA Construct Design for OGNT Overexpression

To assess the effect of overexpression on the three OGNT candidates, plasmids were generated that contained a) a 5' homologous recombination site targeting the ssu locus, b) a 5' UTR (aprt), c) the respective triple HA tagged OGNT gene, d) an intergenic region (CamIR) e) the selection marker gene, f) a 3'UTR (dhfr-ts) and g) a 3' homologous recombination site targeting the ssu locus to support stable expression.

(iv) DNA Construct Design for hCas9 Expression

The plasmid for Cas9 expression was designed analogous to the overexpression plasmids described above, using a published Cas9 sequence codon usage optimized for *L. tarentolae* (Le, et al. (2013) Science 339 (6121), pp. 819-823). In contrast to the constructs for overexpression, the Cas9 expression constructs were usually transfected as circular DNA which should be retained episomally in *L. tarentolae.*

(v) crRNA Design crRNAs were designed based on the target regions (usually coding sequences of OGNT genes) for use with SpCas9 (PAM=NGG) by EuPaGDT (http://grna.ctegd.uga.edu/) and were counterchecked for on-/off-target effects by blast against the whole genome of *L. tarentolae*. crRNAs were then selected such that they are ideally targeting the extremities of the coding sequence to be replaced.

TABLE 4

| crRNAs designed for knockout of OGNT genes. | | |
|---|---|---|
| gRNA_OGNT-1_3 | GTTCTTCGCGAAATCCGATGCGG | SEQ ID NO: 231 |
| gRNA_OGNT-1_5 | ACACGCATGCGGGTGAGGTGAGG | SEQ ID NO: 232 |
| gRNA_OGNT-2_5 | AGTGGTTCACAACCGAATCCCGG | SEQ ID NO: 233 |
| gRNA_OGNT-2_3 | GATGGGCACGGAACGGCCTGTGG | SEQ ID NO: 234 |
| gRNA_OGNT-L_5 | ACGGTGACGCGAACTCGCAGAGG | SEQ ID NO: 235 |
| gRNA_OGNT-L_3 | CTTGTCTCGGTGGCGCCAAGCGG | SEQ ID NO: 236 |

(vi) Transfection Method (A) Preparation of DNA

Restriction digest (12 μg DNA in total volume of 240 μL) was performed using standard restriction enzymes (ThermoFisher, preferably FastDigest) according to the manufacturer's instructions. The restriction digest was performed until completion or o/n at 37° C. and DNA was purified by EtOH precipitation (2 volume 100% ice cold EtOH was added to 1 volume digested DNA, incubated 30 min on ice, centrifuged for 30 min 17'500×g at 4° C. Pellet was washed with 70% EtOH, pellet was dried for maximum 15 min and resuspended in ddH2O). For optimized removal of circularized plasmid, 1 or 2 restriction enzymes with recognition sites in the vector backbones were chosen and digest was done for 1 h at 37° C. and purified by EtOH as described above. The digest was analyzed by agarose gel electrophoresis in 0.7-2% agarose gels (TAE buffer). Optionally, gel extraction was performed with the NucleoSpin® Gel and PCR Clean-up kit (Macherey&Nagel) according to manufacturer's instructions to remove undigested plasmid from the preparation.

(B) Preparation of gRNA for Transfection into a Cell Line with Constitutive Cas9 Expression gRNA for CRISPR/Cas9 mediated genome editing was assembled from tracrRNA and crRNA (Microsynth), by a denaturation step of 95° C. for 5 min and subsequent slow cool down at 0.1° C./s in a thermo cycler. Per transfection 10 μg of tracrRNA and 10 μg of crRNAs (total) were used together with the DNA for integration (1 μg/fragment) that serves as template for homology directed repair.

(C) Preparation of Ribonucleoprotein (RNP) Complexes for Transfection without Constitutive Cas9 Expression gRNA for CRISPR/Cas9 mediated genome editing was assembled from equimolar amounts of tracrRNA and crRNA (Microsynth) as above by denaturation for 5 min at 95° C. and subsequent slow cool down at 0.1° C./s in a thermo cycler. This was done separately for every crRNA used before the different gRNAs were subsequently mixed in equimolar amounts. Next, 122 μmol recombinantly expressed Cas9 protein (i.e. Alt-R® S.p. HiFi Cas9 Nuclease V3 (IDT, #1081061) were added to 360 μmol of the gRNA mix and incubated for 15 min at RT to allow RNP formation. The final volume used for a transfection by Nucleofector (see section E) should not exceed 6 μl. Lastly, the RNP mix was added to the repair DNA containing transfection solution described below along with 1 μl of Alt-RR Cas9 Electroporation Enhancer (IDT, #1081072).

(D) DNA Preparation for Transfection

The linear DNA fragments for integration are mixed for transfection in the needed combinations at 1 μg per fragment. If the CRISPR/Cas9 system was used, the gRNA was prepared as described above and mixed with the integration fragments. The volume of the mix was reduced to maximum 2 μl per transfection in a vacuum concentrator at 30° C. For episomal transfection of Cas9 plasmids, 0.1-1 μg of plasmid DNA were directly used for transfection.

(E) Transfection with Nucleofector

One day before transfection, a densely grown culture of the parental strain was diluted 1:10 into fresh media (BHIH) containing all antibiotics for which selection markers were previously integrated and cultured overnight at 26° C.

Transfection was performed using the 4D-Nucleofector™ Core X with the P3 Primary Cell 4D-Nucleofector™ X Kit (Lonza). For this, DNA (or DNA/RNA or DNA/RNP) as prepared above was mixed with 16.4 μl P3 Primary Cell solution and 3.6 μl Supplement Solution. The equivalent culture volume of $10^7$ cells (OD should be around 0.3-1.0/ml, cell shape round to drop-like) was pelleted by centrifugation at 1800 g for 5 min and the supernatant was removed. The cell pellet was resuspended in 20 μl of the DNA (or DNA/RNA or DNA/RNP) mix and transfected using a 16-well electroporation strip with pulse FI-158 (in some examples alternative pulses FP167, CM150, EO115, DN100, FP158, FB158 were used). As negative control, an additional culture was transfected with ddH2O only.

80 μl of fresh media (BHIH, parental selection markers) was added to each well and 2×45 μl of the mix were transferred to individual wells of a 96 well culture plate that were prefilled with 200 μl of fresh medium. After incubation for 24 h at 26° C. in the dark (recovery), the new selection marker was added at 50% concentration (preselection; see Table 5). After further incubation for 1-2 days, the selection marker was topped up to 100% (main selection, see table) and several dilutions between 1:2 and 1:10 were performed in 96 well format (final volume 250 μl). Cultures were further incubated at 26° C. in the dark for up to 7 days. If no growth was observed, the culture medium was replaced (centrifugation at 1800 g, 10 min, RT) and cultures were again incubated for up to 7 days. This step was repeated if necessary. Growing cultures were expanded in to higher culture volumes by dilutions in the range of 1:5 and 1:20 before analysis.

(F) Transfection with Gene Pulser Xcell™ (Biorad)

Preparation of the *Leishmania* culture for transfection was done by a 1:10 dilution of a densely grown culture in BHIH the day before transfection, static at 26° C. The OD was measured at 600 nm with photometer in single-use cuvettes and ranged be between 0.4-1.0 (4-6×10*7 cells) for optimal efficiency. The cells should be in log-phase, which is indicated by a mixed population out of round and drop-like shaped cells. More round shaped cells were preferred. 10 ml culture was used for one transfection and one culture was always electroporated with ddH2O as negative control for the respective selection marker. For transfection the culture was spun at 1'800× g for 5 min, RT. The SN was removed and pellet resuspended in 5 ml transfection buffer (200 mM Hepes pH 7.0, 137 mM NaCl, 5 mM KCl, 0.7 mM Na2HPO4, 6 mM dextrose, anhydrous (glucose), sterile filtered 0.22 μm). Cells were centrifuged again and the pellet was resuspended in 400 μl transfection buffer. 400 μl of cells were added to the DNA and transferred into the cuvettes and incubate on ice for 10 min. Electroporation was performed with a Gene Pulser Xcell™ (Biorad) using a low voltage protocol (exp. decay: 450 V, 450 uF, 5-6 ms, cuvette: d=2 mm) and immediately put on ice for exact 10 min. The whole content of cuvette was transferred into 10 ml BHIH without any selection marker and cells were grown at 26° C. in dark, aerated, static for 20-24 h. For the selection of a polyclonal cell line, half concentration of selection marker was added and cultures were incubated at 26° C. for 1-2 days and then passaged 1:10 in 10 ml BHIH with full concentration of selection marker. Cells were grown further at 26° C. in dark. If after 7 days cultures were turning into turbid culture, cells would be spun down at 1'800× g for 5 min at RT and pellet resuspended in new BHIH media containing full selection marker concentration.

Similar methods are described in International Publication No. WO2019/002512 A2, incorporated by reference in its entirety herein. Clonal selection For clonal selection, cells were streaked on BHIH plates (containing 1.4% agar and the appropriate 100% selective agent) as soon as the liquid culture turned turbid. Plates were sealed with parafilm and incubated 7-10 days upside down in dark at 26° C. Single colonies (1-2 mm size) were transferred into 24-well plates containing 1 ml BHIH, sealed with parafilm and incubated in dark at 26° C. for around 7-10 days. 1 ml culture was then transferred from 24-well plate into 10 ml BHI is a flask and further grown statically as usual.

(vii) PCR and Sequence Analysis of Deletion Strains (A) Preparation of gDNA-Genomic DNA Isolation by Tissue Kit 2 ml of densely grown *L. tarentolae* culture were pelleted at 1800 g and the supernatant was discarded. The pellet was used for preparation of genomic DNA by the NucleoSpin® Tissue Kit (Macherey-Nagel). For this, the pellet is resuspended in 200 µl of Buffer T1 and further treated according to the manufacturer's instructions until elution. For efficient elution, 50 µl of prewarmed (50° C.) Buffer BE are added to the column and incubated at RT for 3 min. The eluate is collected by centrifugation for 1 min at 11000 g. Repetition of this step as well as reloading of the eluate can be used to increase the yield.

(B) Preparation of Crude Cell Extracts for PCR Analysis

50 µl of culture were washed in 1 ml PBS and pelleted at 1800 g for 5 min. The supernatant was removed and the pellet was resuspended in 50 µl of PBS and boiled at 95° C. for 5 min with intermitted vortexing. 1 µl was used instead of template DNA in the PCR reaction.

(C) PCR Analysis of OGNT KOs

PCR confirmation of OGNT knock-outs was performed by either amplification of the complete locus (OGNT-1, OGNT-2, OGNT-L or OGNT-1+L) or by amplification of the shorter fragments covering the integration sites.

Usually the successful replacement of the wildtype OGNT sequence (OGNT-1=3.4 kbp, OGNT-2=1.9 kbp and OGNT-L-3.4 kbp) by the selection marker coding sequences (0.4-1.0 kbp) with or without the additional intergenic regions (together approx. 0.9 kbp) could be easily confirmed by the size of the amplicon resulting from the PCR targeting the whole native locus, since correct replacement of the wt gene would lead to a much shorter amplicon. For these PCRs LATaq DNA polymerase (TaKaRa) was used in combination with a buffer for amplification of GC rich sequences that allowed the amplification of the long wildtype regions (see Table 5). In some cases, amplification of shorter regions with primer binding within the OGNT coding sequence was preferred to test for presence of remaining wt genes (Table 5). For these, the DreamTaq DNA polymerase (Thermo Fisher Scientific) was used. Alternatively, the correct integration of the selection marker gene into the respective OGNT locus could be tested by combinations of a primer binding in the genome with one primer binding to the selection marker CDS or the intergenic regions of the integrated construct and the other one targeting the genome. This was for example done to confirm the correct integration of the selection marker cassette in the heterozygous KO produced in Example 2 (see "OGNT-2 KO (with IR)", Table 5; primers are listed in Table 6).

TABLE 5

PCRs for analysis of OGNT deletions. PCR primers used for confirmation OGNT knock-outs by absence of the respective OGNT wt gene and the expected amplicon sizes for the wt strain (St10569) are summarized.

| Target gene | Target region | Primers | wt amplicon | KO amplicon |
|---|---|---|---|---|
| OGNT-1 | Whole locus | 6154, 6156 | 4.9 kbp | shorter* |
| OGNT-1 | 3' end | 7173, 7174 | 2.6 kbp | none |
| OGNT-2 | Whole locus | 6043, 6044 | 3.3 kbp | shorter* |
| OGNT-2 | 5' end | 6043, 6047 | 1.3 kbp | none |
| OGNT-2 | 5' end | 7492, 7495 | 0.9 kbp | none |
| OGNT-L | Whole locus | 6157, 6158 | 4.8 kbp | shorter* |
| OGNT-L | Whole locus | 6073, 7163 | 5.5 kbp | shorter* |
| OGNT-L | 5' end | 7175, 7176 | 2.6 kbp | none |
| OGNT-1+L | Whole locus | 6157, 6156 | 8.1 kbp | shorter* |
| OGNT-2 KO(with IR) | 3' end (3'UTR-genome) | 6045, 6044 | none | 0.8 kbp |
| OGNT-L | 3' end (hyg) | 4952, 7163 | None | 2.4 kbp |

*KO amplicon length for whole locus PCRs depends on the combination of selection marker and intergenic regions used.

TABLE 6

Listing of primer sequences used in the described examples.

| Primers | Sequence | Short name | SEQ ID NO: |
|---|---|---|---|
| 4952 | CCGATGGCTGTGTAGAAGTACTCG | Hyg_fw | 53 |
| 6043 | GCTCAGCTGCGAGAGCGTAAACCTCCGTAACAATG | OGNT-2_5'_fw | 54 |
| 6044 | AGCTAAACTCTGCACTCATCTGCGCTTCCGCAAGG | OGNT-2_3'_rev | 55 |
| 6045 | ACTATCATGCCCTACGTGGGCCACGCAGCGATGAG | 3'UTR-dhfr_fw | 56 |
| 6047 | GCGTCTCACCGCTTGCCAGGTCTTCTACTCCAATG | OGNT-2_rev | 57 |
| 6073 | TGGTGGAGGAGGGTGCGGAGGATG | OGNT-L_3'_fw | 58 |
| 6154 | ATCTGGAGGATGTCTACGTGACACAGGCGCTCTGG | OGNT-1_5'(internal)_rev | 59 |

TABLE 6-continued

Listing of primer sequences used in the described examples.

| Primers | Sequence | Short name | SEQ ID NO: |
|---|---|---|---|
| 6156 | CGCACAGGGTGACGAGGAAAGCAGTATCGAAACAG | OGNT-1_3'_fw | 60 |
| 6157 | CGACCGCGATATCTGCTTTCCATTCTGCAGTTCTC | OGNT-L_5'_rev | 61 |
| 6158 | CTTTACACAGGCGGTCACGTGAGTGTCCATGAGAG | OGNT-L_3'(internal)_fw | 62 |
| 7163 | AGCACATGTTTCGGCAGGTC | OGNT-L_3'_rev | 63 |
| 7173 | CGCACCTCGGCTTCAACTGCCAATG | OGNT-1_rev | 221 |
| 7174 | AACGTGCCTGAAGCCCGTAGCTTTG | OGNT-1_fw | 222 |
| 7175 | GGCGACGGATGATGCCCACCATTTG | OGNT-L_rev | 223 |
| 7176 | GGAGGCAACCAAGAAGGCGTCAGAG | OGNT-L_fw | 224 |
| 7492 | CCATGGCCAGATGCCAAGCTTACTC | OGNT-2_5'_fw | 225 |
| 7495 | CGGAACACAGACCTGCCATCTGTGG | OGNT-2_5'_rev | 226 |

(D) OGNT Deletion Sequencing

St16248, St16257, St16249, St16636, St16700, St16702 and St16704 genomic DNA was sequenced on Illumina NextSeq (2× 150 bp paired-end sequencing; TruSeq library preparation according to the manufacturer's specification). The resulting quality trimmed data consists of approximately 20M paired reads per strain. BWA-MEM (Li (2013) Available online at http://arxiv.org/pdf/1303.3997v2) was used to align the reads to the reference sequence, resulting in an average coverage of 186-fold across the whole genome. Complete absence of reads matching to the respective OGNT region indicate a successful removal of the OGNT gene.

(viii) Expression Analysis by Western Blot (A) Sample Preparation and Expression Analysis by Western Blot Cells were grown for 2-3 days at 26° C., static (e.g. in 3 ml in a 6-well plates). Whole cell extract (WCE) corresponding to 0.05 OD and cell free culture supernatants corresponding to 0.05 OD are analyzed by Western blot. For supernatant analysis, grown culture was centrifuged at 1800 g at RT for 5 min and cell free supernatant was transferred to a new tube and mixed with Laemmli dye under reducing or non-reducing conditions. Cell pellets for WCE were washed with 1×PBS, centrifuged again at 1800 g at RT for 5 min and frozen at −80° C. for minimally 30 min. After thawing it again at RT pellet was then resolved in Leammli (reducing) buffer, boiled again at 95° C. for 10 min and vortexed intensively before loading on 4-12% Bis-Tris SDS PAGE, using a MOPS running buffer with 200 V for 60 min. Gels were blotted using an Iblot device for 7 min on PVDF membranes. Membranes were blocked for at least 30 min at RT in 10% milk. Polyclonal rabbit anti-HA antibody (H6908, Sigma) was used in 1:2000 in 1% milk, 1×PBST for o/n incubation at 4° C. Afterwards, the blot was washed with 1×PBST three times for 5 min before secondary antibody detection with horse reddish peroxidase (HRP) coupled goat anti rabbit antibody (170-6515, BioRad) used 1:4000 in 1% milk, 1×PBST for 3 h rotating at 30° C., followed by three washes for 5 min in 1×PBST and one component 3,3',5,5'-tetramethylbenzidine (TMB) substrate staining for colorimetric detection (TMBM-1000-01, Surmodics).

5.6.2 Anti-TNFa "Adalimumab" Expression, Purification and Analysis in *L. tarentolae* Derived CustomGlycan Host Cells (i) Large Scale Expression and Purification A 10 L bioreactor of St15449, a recombinant strain based on St10569 (wt), with ssu integrated adalimumab expression cassette (containing 5'UTR_Adalimumab_LC_intergenic region_Adalimumab HC_intergenic region_sat_3'UTR; resistant to nouseotricin) was grown in BHIH for 50.8 h and harvested at an OD of 15. Cultures were harvested and centrifuged for 30 minutes at 8000× g and SN filtrated through 0.45 μm+0.22 μm filter cartridge (Sartorius, 544307H9-SS-A) and supplemented with 5 tablets PIC (Protease inhibitor cocktail, complete, EDTA-free, Roche, 05056489001) and EDTA to 5 mM.

Media SN was loaded offline over night with peristaltic pump at 4° C. continuously on 2×5 ml protein A Column (HiTrap MabSelect PrismA, GE Healthcare, 17-5498-53). Column was connected to NGC System and washed with 10 CV 1×PBS pH 7.4. Elution was performed with 0.15M Glycine pH 2.5 and directly neutralized by adding 150 μl 1M Tris pH 8.5. Pooled fractions containing adalimumab were buffer exchanged to PBS pH 6. Adalimumab pools were adjusted with Tris and (NH4)2SO4 and loaded on a 2×5 ml HIC (HiTrap Capto Phenyl HP) with a flow rate of 1 ml/minute, and eluted with a Buffer A 20 mM Tris, 1M (NH4) 2SO4 pH 7.0 and Buffer B 20 mM Tris pH 7.0 gradient. Fractions were collected and analyzed by coomassie SDS PAGE and western blot. Final pools were buffer exchanged to PBS pH 6 and stored at −80° C.

(ii) Fed-Batch Fermentation for Analysis of Deletion Strains

OGNT deletion strains St16704 (OGNT-1/L KO) and St16636 (OGNT-1/2/L KO) were subjected to fed-batch fermentations in a bio-/® xpac multi-bioreactor system. Cells were grown in BHIH (⅔ of total fermentation volume) for 50 h before a concentrated feed (56 g/L Yeast extract, 32 g/L soy peptone, 28.8 g/L glucose, 15 mg/L hemin; ⅓ of total volume) was at a constant rate. The cultures were harvested after 94 h and centrifuged for 30 min at 3220× g, 4° C. 50 ml of the supernatant were subjected to small scale Protein A enrichment of Adalimumab as described below.

(iii) Small Scale Expression, Purification of Adalimumab

Host cells were routinely grown in 50 ml culture in BHIH for 48 h at 26° C. shaking at 140 rpm. Cultures were harvested and centrifuged for 10 min at 1800×g at RT. Media SN was filtered through 0.22 μm filter (Steriflip, SCGP00525) and EDTA (0.5 M pH8) was added to each load in a 1:100 dilution. Media SNs of each strain were subjected to 4 h incubation with 100 μl of proteinA resin (ProteinA-Sepharose 4B Fast Flow, Sigma Aldrich, P9424) per Falcon tube in batch while rotating at RT. After treatment with ProteinA resin, the samples were centrifuged at 500×g for 5 min, the FT was discarded and the resin was transferred to spin columns. Washes were performed with 3×5 CV using Buffer A (pH 7.2 20 mM Na2HPO4, 150 mM NaCl, pH was adjusted with HCl to 7.20) using 500 μl for 100 μl resin; with centrifugation at 1000×g, RT, 1 min between each step. Elution was performed with several CV of Buffer B (0.1 M acetic acid, 100 mM NaCl, pH was adjusted with 1 M NaOH to 3.20) using 100 μl for 100 μl resin, with centrifugation at 1000×g, RT, 1 min between each step (e.g. 3×1CV and 1×0.5 CV).

Elution fractions were pooled and immediately neutralized by adding 100 mM Tris-HCl (1 M pH8). Afterwards, the pooled elutions were buffer exchanged to PBS pH 6 using 2 ml 7K ZebaSpin desalting columns and optionally concentrated using Amicon 0.5 ml 30 K concentrators.

Samples were then subjected to analyses such as O-HexNac quantification as described below.

5.6.3 LMSAP-rhEPO-Strep Expression, Purification and Analysis in *L. tarentolae* Derived CustomGlycan Host Cells Host cells were grown in 1 L culture in Yeast Extract media for 72 h at 26° C. shaking at 140 rpm. Cultures were centrifuged at 8000 g, 4° C. for 30 min and the supernatant was harvested for precipitation with 40% ammonium sulfate (45 min at RT). The precipitate was collected by centrifugation for 1 h at 11000 g, 4° C. and subsequently resuspended in 50 ml PBS pH7.4. The sample was dialysed (SpectraPor™ dialysis membrane, MWCO 3.5 kDa) against 5 l PBS pH7.4 for 2 h and against another 5 l PBS pH7.4 overnight at 4° C. After filtering through a 0.22 μm filter (Steriflip, SCGP00525), the sample was loaded overnight in recirculation at 4° C. on a 1 ml StrepTrap™ HP (StrepTrap™ HP, GE Healthcare, 29-0486-53) column. After washing with 20 CV PBS pH7.4, LMSAP-rhEPO-Strep was eluted using 2.5 mM desthiobiotin in PBS pH7.4 (5 CV in 0.5 ml fractions) and concentrated using AmiconUltra-0.5 concentrators.

Samples were then subjected to glycopeptide analysis.

5.6.4 Analysis (i) SDS PAGE and Capillary Gel Electrophoresis

SDS PAGE was performed under reduced or non-reducing conditions using 10 μg for Coomassie, 2.5 μg for WB, separated on 4-12% Gel with MOPS buffer for 55 minutes. Determination of Protein purity was done by Coomassie Stained SDS-PAGE with 10 μg protein sample and compared to a BSA standard curve. Impurities were quantified by ImageQuant. Capillary Gel Electrophoresis (CGE) was performed using an Agilent Protein 230 Kit (5067-1518), according to protocol.

(ii) Analytical SEC

MAbPac SEC-1 (4×300 mm) is a size exclusion chromatography (SEC) column specifically designed for separation and characterization of monoclonal antibodies (mAbs) and was used according to manufacturer's recommendation (Temperature: 30° C.; Eluent: PBS 50 mM NaPO4, 300 mM NaCl pH 6.8; Elution: isocratic, 30 minutes; Flow: 0.2 mL/minute; Detection: 215 nm; Injection V: 5 μL corresponding to 5 μg protein).

(iii) O-HexNAc Identification

Intact monoclonal antibodies were analyzed by mass spectrometry employing the state-of-the-art instrumentation (Orbitrap FTMS), data processing and data analysis (bioinformatics) tools by SpectroSwiss. In addition to the intact measurement the antibody was reduced with TCEP or enzymatically cleaved (IdeS) to generate Fd, LC and Fc/2 subunits, which were analyzed using the same instrumentation.

(iv) Sample Preparation for IdeS Derived Subunit Analysis

To generate mAb subunits of about 25 kDa each, IdeS (FabRICATOR, Genovis, Lund, Sweden) digestion of mAbs was performed in formulation buffers. One unit of IdeS was added to each ug of mAbs and left to react for 30 minutes at 37° C. Then, mAbs were denatured and reduced by incubation with 6 M GdnCl and 30 mM TCEP at room temperature for 30 minutes. Finally, the reaction was quenched by acidifying the solution to 1% TFA. For the analysis samples were diluted with 0.1% FA in water to a final concentration of 1 ug/ul.

(v) Mass Spectrometry for Intact and Subunit Analysis, Bioinformatics and Data Processing.

A standard Orbitrap-based intact protein mass measurement set-up (a triplicate LC-MS experiment) was employed using:

- Analytical HPLC (Dionex) with 30 min run duration,
- Analytical column (Waters), C4 Aquity, BEH, 90 μl/min @60 C,
- Q Exactive HF FTMS (Thermo),
- FTMS Booster (Spectroswiss), advanced data acquisition system
- Full MS resolution: 30'000 @ m/z 200 for intact mAb and 60'000 @ m/z 200 for subunit analysis
- Charge target number (ion number): AGC of 3e6

Intact Mass (Protein Metrics) was employed for mass spectra deconvolution of intact mAbs. MASH Suite software tool (open access, Wisconsin University, Ying Ge Group) was used for deconvolution of the mass spectra of the subunit analysis. The employed resolution enabled obtaining isotopically-resolved data. Peak-by-Peak software tool (Spectroswiss) was employed for time domain signals and mass spectra processing. The employed methods enabled obtaining high spectral dynamic range data.

(vi) O-HexNAc Localization by Peptide Mapping

To localize the HexNAc modification observed on the Fd subunit a bottom-up proteomics approach using trypsin and chymotrypsin digests and HCD and ETD fragmentation was carried out by SpectroSwiss employing the state-of-the-art instrumentation (Orbitrap FTMS), first untargeted and additionally targeted against the most promising peptides. A standard trypsin digestion protocol was employed using ~5 ug of protein (concentration around 1 ug/ul). 6 μl 2M Urea, 50 mM TEAB were added, the sample was reduced by adding 1.5 μl of 20 mM TCEP and alkylated with 1.5 μl of 80 mM Chloroacetamide (incubation 1 h at RT) before the digestion with 0.2 μg Trypsin for 2 h at 37° C. The digestion was stopped using 10 μl 0.2% TFA and the sample centrifuged and the supernatant was used for the injections.

A standard Orbitrap-based bottom-up proteomics set-up (a triplicate LC-MS experiment) was employed using:

Nano HPLC (Dionex) with 140 min run duration

Q Exactive Plus FTMS with HCD employed as MS/MS technique

Full MS resolution: 70'000 @ m/z 200

Charge target number (ion number): AGC of 3e6

MS/MS resolution: 17'500 @ m/z 200

Charge target number (ion number): AGC of 1e5

MS/MS method: HCD with 27 NCE

Data dependent acquisition: top 10

Dynamic exclusion: 60 s

Scaffold (Proteome Software Inc.) was employed for data analysis with the following parameters set:

Variable modifications: +1 on NQ (Deamidated), +16 on M (Oxidation), +42 on N (Acetyl)

Digestion Enzyme: SemiTrypsin

Max Missed Cleavages: 2

Scaffold: Version Scaffold 4.8.3

Protein Grouping Strategy: Experiment-wide grouping with binary peptide-protein weights Peptide thresholds: 90.0% minimum Protein thresholds: 95.0% minimum and 1 peptide minimum Peptide FDR: 0.2% (Decoy)

Protein FDR: 9.2% (Decoy)

Peaks software was employed for a more detailed data analysis, specifically PTMs analysis.

Peak-by-Peak software tool (Spectroswiss) was employed for time domain signals and mass spectra processing. The employed methods enabled obtaining high spectral dynamic range data.

(vii) O-HexNAc Characterization by Monosaccharide Analysis by High Performance Anion Exchange Chromatography Coupled with Pulsed Amperometric Detection, HPAEC-PAD For confirmation of O-glycosylation and the determination of the amount of O-HexNAc found on T225 of the heavy chain of Adalimumab a 14 amino acid glycopeptide was generated using FabRICATOR (IdeS) (Genovis AB, Lund, Sweden) and GingisKHAN (Kgp) (Genovis AB, Lund, Sweden) following the product manuals in combination with several purification steps.

In short, 2 mg commercial Humira or Adalimumab purified from *L. tarentolae* were first incubated with PNGaseF (add 50 U, 3 h at 37° C.) for N-glycan removal to reduce possible interferences of N-glycan derived monosaccharides during the monosaccharide analysis. The PNGaseF treated sample was then incubated with FabRICATOR (2000 U) overnight in PBS pH 7.1 at 37° C. The digest was purified after via an in-batch CaptoL purification step (3 h at RT) to remove the Fc/2 fragments. The remaining F (ab) 2 fragments were concentrated with a Pierce PES 3 kDa column and re-buffered to 0.1M Tris pH 8, 0.1M NaCl with a ZebaSpin column. The re-buffered sample was incubated with GingisKHAN (2000 U) overnight at 37° C. in the presence or 2 mM cysteine. The sample was reduced with TCEP for 20 min (20 mM) before the 14 amino acid peptide containing the O-HexNAc site was purified using a 10 kDa Pierce PES column, which retains LC and Fd fragment. The presence of the 14 amino acid peptide with and without the O-HexNAc modification was confirmed by MALDI. During the MALDI measurements no subunits (LC, Fc/2, Fd) were identified.

The monosaccharide found as a O-glycosylation on the 14 amino acid peptide ("10k permeate") was analyzed by HPAEC-PAD and the monosaccharide peak were identified by comparison to commercially available monosaccharide standards. The monosaccharides were released from the bioconjugate by TFA hydrolysis (2M TFA for 2 h at 121° C.). Commercial monosaccharide standards GlcNAc, GalNAc and ManNAc used were also treated with TFA to resemble the monosaccharides that were released from the mAb (GlcN, GalN and ManN after TFA hydrolysis). The resulting underivatized monosaccharides are separated on a CarboPac PA1 column 4×250 mm (Thermo Fisher Scientific) by eluting with NaOH/NaOAc and subsequent detection by pulsed amperometric detection (PAD). The sugar identity could be determined by overlaying the released monosaccharides from the mAb with the corresponding monosaccharide standards.

(viii) O-HexNAc Characterization by MS Fragmentation

An LC-MS/MS approach was carried out in the Group of Manfred Wuhrer at Leiden University (Medical Center (LUMC), Center for Proteomics and Metabolomics, Leiden, The Netherlands) to confirm the identity of the O-HexNAc, more specifically, whether it corresponds to an N-acetylglucosamine (GlcNAc) or N-acetylgalactosamine (GalNAc). It has previously been demonstrated that the pattern of oxonium ions obtained in the MS fragmentation can be used to discriminate between a GalNAc and a GlcNAc (Halim et al. (2014) J Proteome Res 13 (12), pp. 6024-6032). Especially the ratio between the intensities of the ions at m/z 138.055 and m/z 144.066 is very different between a GalNAc and a GlcNAc. Unfortunately, no such information for a peptide with N-acetylmannosamine (ManNAc) is currently available. The modification site has been identified on a threonine in the tryptic peptide THTCPPCPAPELLGGPSVFLFPPKPK (SEQ ID NO:227) (modified Thr underlined) from the antibody's heavy chain. The same antibody produced in CHO cells was also available without this specific modification (Humira as Control Ab). A trypsin digestions was performed and a series of LC-MS/MS analyses of these two samples, followed by manual data analysis to look for the specific glycopeptides.

To obtain the glycopeptides an in-gel trypsin digestion was carried out after a reducing SDS-PAGE (10 μg protein in 10 μl were loaded) for the HC bands of Humira (Control Ab) and the LMTB Adalimumab with O-HexNAc modification (HexNAc Ab, which were analyzed in duplicate using an LC-MS/MS method on a Orbitrap Fusion Lumos mass spectrometer.

For in-gel digestion, an in-house digestion robotic system was used. During this procedure, gel plugs were first washed with 400 μl 25 mM NH4HCO3 and dehydrated using acetonitrile. Proteins were then reduced and alkylated using DTT (10 mM) and iodoacetamide (50 mM), respectively. Subsequently, trypsin was added and proteins were digested overnight. The next day, the tryptic peptides were collected and freeze dried. Prior to LC-MS/MS analysis, tryptic peptides were reconstituted in 30 μl of 0.1% formic acid of which 1 μl was used for each individual LC-MS/MS analysis.

LC-MS/MS analysis was performed on Orbitrap Fusion Lumos mass spectrometer (Thermo). Tryptic peptides were separated using water+0.1% formic acid as solvent A and acetonitrile+0.1% formic acid as solvent B. The separation was performed using a linear gradient of 10-40% solvent B at 250 nl/min for 40 min. Peptides eluting from the gradient were analyzed by mass spectrometry on an Orbitrap Fusion Lumos instrument (Thermo). First, peptides were analyzed in a discovery type of MS/MS experiment. For this purpose, MS scans were recorded with a resolution of 120000. Further, an AGC target of 4*105 and an injection time of 50 ms were used. Charge states of 2-5 were included and masses were dynamically excluded for 10 s after detection. An intensity threshold of 5*104 was used. Data dependent MS/MS fragmentation (Cycle time, 3 sec between master scans) was performed using higher-energy collisional dissociation (HCD) with a collision energy of 32%. For MS/MS scans, the orbitrap resolution was set to 30000, the AGC target was set to 5*104 and the maximum injection time to 30 ms. Additionally, glycosylation modifications were specifically targeted by MS/MS via an MS2 inclusion list looking for HexNAc losses (m/z 204.087). The AGC target was set to 5*105 with a maximum injection time of 200 ms. HCD collision energies of 32%, 37% and 42% were used for fragmentation. Further, MS/MS scans with a CID collision energy of 35% were acquired. Data analysis was performed manually.

(ix) Confirmation of Absence of O-HexNAc in KO Cell Lines

To confirm the absence of the O-HexNAc on Adalimumab in KO-lines in addition to MALDI measurements a peptide mapping was carried out using a trypsin digest and HCD fragmentation employing the state-of-the-art instrumentation (Orbitrap FTMS) in a targeted approach (see sections on O-HexNAc localization by peptide mapping).

(x) Quantification of O-Glycosylation on Glycopeptide by MALDI-TOF MS

For the quantification of O-glycosylation with O-HexNAc found on T225 of the heavy chain of Adalimumab an 14 amino acid glycopeptide was generated using successively FabRICATOR (IdeS) (Genovis AB, Lund, Sweden) and GingisKHAN (Kgp) (Genovis AB, Lund, Sweden). For digesting the sample it was re-buffered in 0.1 mM Tris buffer (pH 8.0) and ~10 µg (10 µl) of sample was incubated for 1 h at 37° C. with 0.5 µl FabRICATOR (ca. 30 U). After that, 1 µl of GingisKHAN (ca. 10 U) and 2 mM reducing agent (cysteine) were added and incubated for 3 h at 37° C. To reduce the disulfide bridges of the hinge region 0.5 µl of 1M TCEP was added (50 mM final concentration) and incubated for 60 min at RT.

Samples were desalted employing C18 ZipTip pipette tips (Millipore) according to the manufacturer's instructions and then spotted onto a ground steel target plate in α-Cyano-4-hydroxycinnamic acid (HCCA; 5 mg/ml HCCA in 40% acetonitrile with 0.1% trifluoroacetic acid). Matrix. MALDI-TOF MS was performed using an UltrafleXtreme Matrix-assisted laser desorption/ionization-time of flight/time of flight (MALDI-TOF/TOF) mass spectrometer (Bruker) operated in reflector positive ion mode. The instrument was operated with flexControl 3.4 (Bruker) using a laser intensity of 30-40%, a mass range of m/z 700-3500, a two-fold detector gain and a sample rate of 2.5 GS/s. 3000 laser shots in 500 shot steps were summed up. The spectra were processed in flexAnalysis 3.4 (Bruker) with a signal/noise cut-off of 5 as well as smoothing and baseline subtraction using the TopHat algorithm. Picking of the peaks of interest was performed manually considering the unglycosylated and O-glycosylated versions of the same peptide. The relative abundances of O-glycosylated peptides was determined by integrating the areas of the monoisotopic masses of the $H^+$ and $Na^+$ ions and relating them to the sum of the intensities of all identified peptide forms.

(xi) Analysis of N-glycans released from purified proteins and cells surfaces by HILIC-UPLC-MS Enzymatic release of N-glycans from purified proteins was performed using Rapid PNGase F (New England Biolabs) as recommended by the supplier. 8 µl of sample (15 µg of protein) were mixed with 2 µl Rapid Buffer and 1 µl of Rapid PNGase F. The mixture was incubated at 50° C. for 10 min followed by 1 min at 90° C. Enzymatic release of N-glycans from cell surfaces was performed using PNGase F (New England Biolabs). 50 mg of cells were re-suspended in Glyco Buffer 2 and incubated with 1 µl PNGase F for 1 h at 37° C. and 650 rpm. Cells were pelleted by centrifugation and 75 µl of the supernatant was dried down in a SpeedVac concentrator. Glycans were re-suspended in 10 µl of water. Following release, glycans were directly labeled with procainamide as described previously (Behrens et al. (2018) Glycobiology 28 (11), pp. 825-831). Briefly, released glycans were mixed with 1 µl acetic acid, 8 µl of a procainamide stock solution (550 mg/ml in DMSO) and 12 µl of a sodium cyanoborohydride stock solution (200 mg/ml in $H_2O$). Samples were incubated for 60 min at 65° C. and cleaned up using LC-PROC-96 clean up plates (Ludger Ltd) according to the manufacturer's instructions.

Procainamide-labeled N-glycans were analyzed by hydrophilic interaction chromatography-ultraperformance liquid chromatography-mass spectrometry (HILIC-UPLC-MS) using am Acquity UPLC System (Waters) with fluorescence detection coupled to a Synapt G2-Si mass spectrometer (Waters). Glycans were separated using an Acquity BEH Amide column (130Å, 1.7 µm, 2.1 mM×150 mM; Waters) with 50 mM ammonium formate, pH 4.4 as solvent A and acetonitrile as solvent B. The separation was performed using a linear gradient of 72-55% solvent B at 0.5 ml/min for 40 min. Fluorescence was detected at an excitation wavelength of 310 nm and a detection wavelength of 370 nm. The Synapt G2-Si mass spectrometer fitted with a Zspray electrospray source was used for mass detection in positive resolution mode using the following parameters: Scan range: m/z 300-3500; scan time: 1 sec; capillary: 2.2 kV; source temperature: 120° C. and sampling cone: 75 V. MassLynx 4.2 (Waters) was used for data acquisition. Data processing and analysis was performed using Unifi 1.9.4.053 (Waters). Glucose units were assigned using a fifth-order polynomial distribution curve based on the retention times of a procainamide-labeled dextran ladder (Ludger Ltd). Glycan structures were assigned based on their m/z values and their retention times and matched against a previously constructed N-glycan library. For individual samples the UPLC was coupled to a Synapt HDMS mass spectrometer using comparable settings.

For a few samples Waters RapiFluor labelling kit, mostly following the Waters Application Note: «Quality control and Automation Friendly Glyco Works RapiFluor-MS N-Glycan Sample Preparation» that were analyzed using the same instrumentation as the procainamide labelled glycans.

(xii) EPO Glycopeptide Analysis (A) Determination of N-Glycosylation Site Occupation and Site Specific Glycosylation Rapigest® SF was used to enhance enzymatic digestion of the proteins in 50 mM ammonium bicarbonate. 180 µg of protein corresponding to 250 µL of each sample were prepared in 50 mM ammonium bicarbonate buffer, pH 8 by Vivaspin 500 PES (5 kDa) and four centrifugations (15'000× g; 10 min, 4° C.). The final concentration of the protein was about 3 mg/ml.

The protein was denatured in 0.1% Rapigest® SF, reduced by DTT (5 mM) at 60° C. for 45 minutes and alkylated by iodoacetamide (15 mM) in the dark for 45 minutes at room temperature according to Rapigest® SF protocol (WATERS). The sample was incubated for 16 hours, at 37° C. with 6.4 µg Trypsin/Lys-C Mix, Mass Spec Grade (Promega V507A #201254) to obtain the digested protein. The hydrolytic surfactant was removed by adding 0.5% TFA to the digested protein sample and incubated at 37° C. for 30 minutes and centrifugation at 15000 g for 10 minutes. All tryptic peptides were purified on SEP Pack C18, 200 mg (Waters) in 0.1% TFA in water. The elution volume, 2 mL of 70% acetonitrile, 0.1% TFA, was completely dried by lyophilisation.

Peptides were solubilized in 40 µL ultra-pure water and 30 µl were used for glycopeptide enrichment according to ProteoExtract® Glycopeptide Enrichment Kit protocol 72103-3 (Novagen).

30 µL of sample were added to 150 µL of ZIC Glycocapture Resin and the flow through containing non-bound peptides was collected. Glycopeptides were eluted with 225 µL ZIC Elution Buffer. The flow through and eluted samples were completely evaporated in speed vac. Glycopeptides were resuspended in 15 µL of MilliQ water. After purification on Zip Tips MILLIPORE C18 to improve the signal/noise ratio, the glycopeptide solution in 50% methanol was dried on maldi plate and 1 µl of CHCA (LaserBiolabs) matrix solution (7 mg/mL 50% acetonitrile) was added.

Five µL of suspended glycopeptides were adjusted to 50 mM sodium acetate buffer and 1 µL of PNGase F (Promega V483A #226517) and 1 µL of PNGase A (Sigma #01000353) were added to deglycosylate during 16 hours at 37° C. The deglycosylated peptides after preparation on Zip Tips MILLIPORE C18 (SOP P17/2) were mixed with CHCA (1:1) (LaserBiolabs) matrix solution (7 mg/mL 50:50 acetonitrile/water, 0.1% TFA).

The flowthrough fractions were prepared and analysed with CHCA (1:1) (LaserBiolabs) matrix solution (7 mg/mL 50:50 acetonitrile/water, 0.1% TFA).

Peptides in the flow through fraction, deglycosylated glycopeptides and occupied glycopeptides were analysed by MALDI-TOF MS mass spectrometry in positive mode reflectron and linear modes. Linear mode MALDI mass spectra were acquired on MALDI-TOF/TOF Autoflex III (Bruker Daltonics). Acquisition conditions were: 14.3×2904V, laser 49%, 6000 shots. Positive ion reflectron MALDI mass spectra were acquired on MALDI-TOF/TOF Autoflex III (Bruker Daltonics) (SOP 44/1). Acquisition conditions with RP850-3500 Bruker method were 40×2160V; laser 97%, 5000 shots.

(B) Sample Preparation and EPO-O-Glycosylation Peptide Analysis by LC-MS

For EPO O-glycopeptide analysis a filter aided sample preparation (FASP) for purified protein using trypsin digest was applied. The Amicon 30kd centrifuge filter unit (Millipore, Cat. UFC503096) was primed by washes with water for two times, centrifuged each time at 10,000 g for 10 min while FT was discarded. 100 µg of purified EPO sample was added on the Amicon filter, and ABC-Buffer (0.05M NH4HCO3 in water pH 8.0) was added up to 400 µl. Filters were centrifuged at 10,000 g for 10 min, washed once with 400 µl ABC-buffer, centrifuged again and FT discarded. All further centrifugation steps were performed at 10,000 g for 10 min Proteins were then reduced with 100 µl of 50 mM DTT in ABC-Buffer for 30 min at 37° C. and filters thereafter centrifuged, washed with 400 µL ABC-Buffer and centrifuged again. Next, proteins were alkylated with 100 µl of 65 mM IAA in ABC-Buffer for 1 hr at RT in the dark and filters were then centrifuged, washed three times with 400 µl ABC-Buffer and centrifuged each time and FT was discarded.

The column was transferred to a new collection tube, in which 2 µl Trypsin (1 ug/ul) and 98 µl ABC-Buffer was added to hEPO (wt) to obtain an Enzyme: Protein ratio of 1:20. More trypsin (1.5 µl, 1 ug/ul) and 98.5 µl ABC-Buffer was added to hEPO derived from the triple OGNT-KO to retain an Enzyme: Protein ratio of 1:20. Samples were incubated the overnight at 37° C., for 16 h without shaking. The peptides were collected by centrifugation and the FT was transferred to a low binding tube. 400 µl $H_2O$ was added on the Amicon, and rinsed by pipetting, centrifuged and the FT was transferred to the same low binding tube. Then, 400 µl 10% AcN was added on the Amicon, carefully rinsed by pipetting and followed by centrifugation to collect remaining FT in the same low binding tube. Samples were dried in the SpeedVac at RT overnight. Resuspension of the sample was performed with 25 µl 5% acetonitrile+0.1% formic acid and 10 µl of which 10 µl were injected into the LC-MS.

Tryptic peptides were analyzed using am Acquity UPLC System (Waters) with UV detection coupled to a Synapt G2-Si mass spectrometer (Waters). Peptides were separated using an Acquity UPLC Peptide BEH column (130Å, 1.7 µm, 2.1 mM×150 mM; Waters) with 0.1% formic acid in water as solvent A and 0.1% formic acid in acetonitrile as solvent B. The separation was performed using a linear gradient of 0-38% solvent B over 120 min. The Synapt G2-Si mass spectrometer fitted with a Zspray electrospray source was used for mass detection in positive resolution mode using the following parameters: Scan range: m/z 50-2000; scan time: 0.5 sec; cone voltage: 37 V. MSe was used for fragmentation with 4 V in the trap and 2 V in the transfer cell for low energy scans; and a ramped collision energy of 15-45 V in the trap cell for high energy scans. Data analysis was performed using Byonic and Byologic (Proteinmetrics).

6. EXAMPLES

6.1 Example 1—Identification of O-HexNAc Modification on rhEPO and Recombinant IgG1

6.1.1 rhEPO

The CustomGlycan platform is developed for manufacturing recombinant and function customized glycoprotein therapeutics and the composition and methods of producing glycoproteins in vivo have been described (International Publication No. WO2019/002512 A2, incorporated by reference in its entirety herein). Recombinant human Erythropoietin (rhEPO) contains three N-glycosylation sites, and one O-glycosylation site, latter was being modified upon expression in *L. tarentolae* with an single HexNAc attached to Serine 126, exemplified in CustomGlycan host cells St11521 and St11895 (International Publication No. WO2019/002512 A2, for example FIG. 19 and method section 8.11.9: Determination of N-glycosylation site occupation and site specific glycosylation). In both cases, St11521 and St11895 the mass of a peptide ion at m/z 1668.892 corresponded to the tryptic O-glycopeptide, position [117-131] [EAISPPDAASAAPLR] (SEQ ID NO:237) with one HexNAc residue bound. EPO O-glycopeptide was present in the flow through fraction and in the enriched glycopeptide fraction as peptide occupied with one HexNAc residue. This peptide was not detected in its non-glycosylated form (FIG. 1).

6.1.2 Rituximab

Recombinant expression of human IgG1 antibodies such as Rituximab and Adalimumab was also performed in *L. tarentolae* derived CustomGlycan host cells. Purified mAbs were in-depth characterized for (post-translational) modifications such as glycosylation. While Rituximab led to some variants at the N-terminus due to the suboptimal cleavage of the secretion peptides preceding heavy chain (HC) and light chain (LC) sequences (International Publication No. WO2019/002512 A2, for example Table 12 and FIG. 44), some additional hints from subunit analysis were obtained, pointing towards an additional modification matching the mass of a HexNAc for approximately 20% of the total mAb (data not shown). Further analyses using high-end MS methods were not undertaken on Rituximab due to the heterogeneity of the sample leading to high complexity in MS data interpretation.

6.1.3 Adalimumab (i) Identification

Next, anti-TNF alpha IgG1, Adalimumab, heavy and light chains were co-expressed in *L. tarentolae* CustomGlycan host cells with optimized secretion peptides. Adalimumab was Protein A and HIC purified from the supernatant for the characterization of the recombinant mAb preparation by MS, such as intact protein, subunit analysis and peptide mapping methods.

Figure 2A:
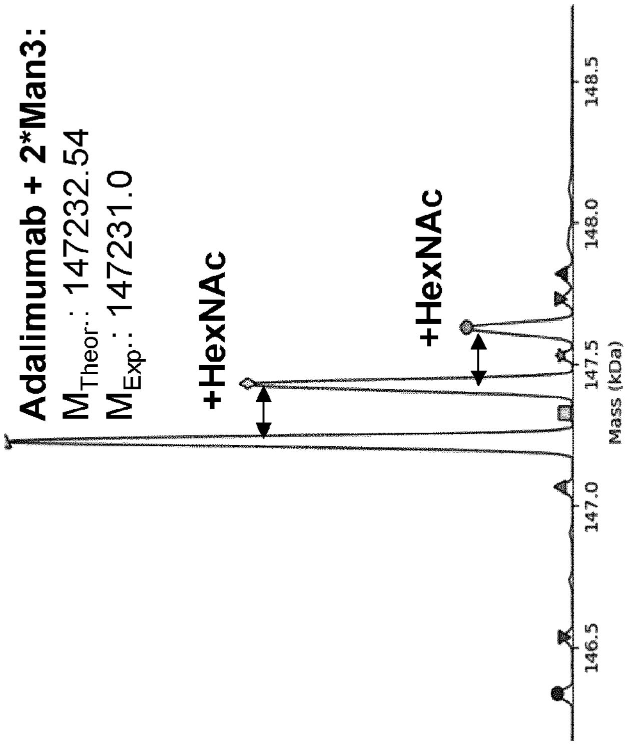
Figure 2B:
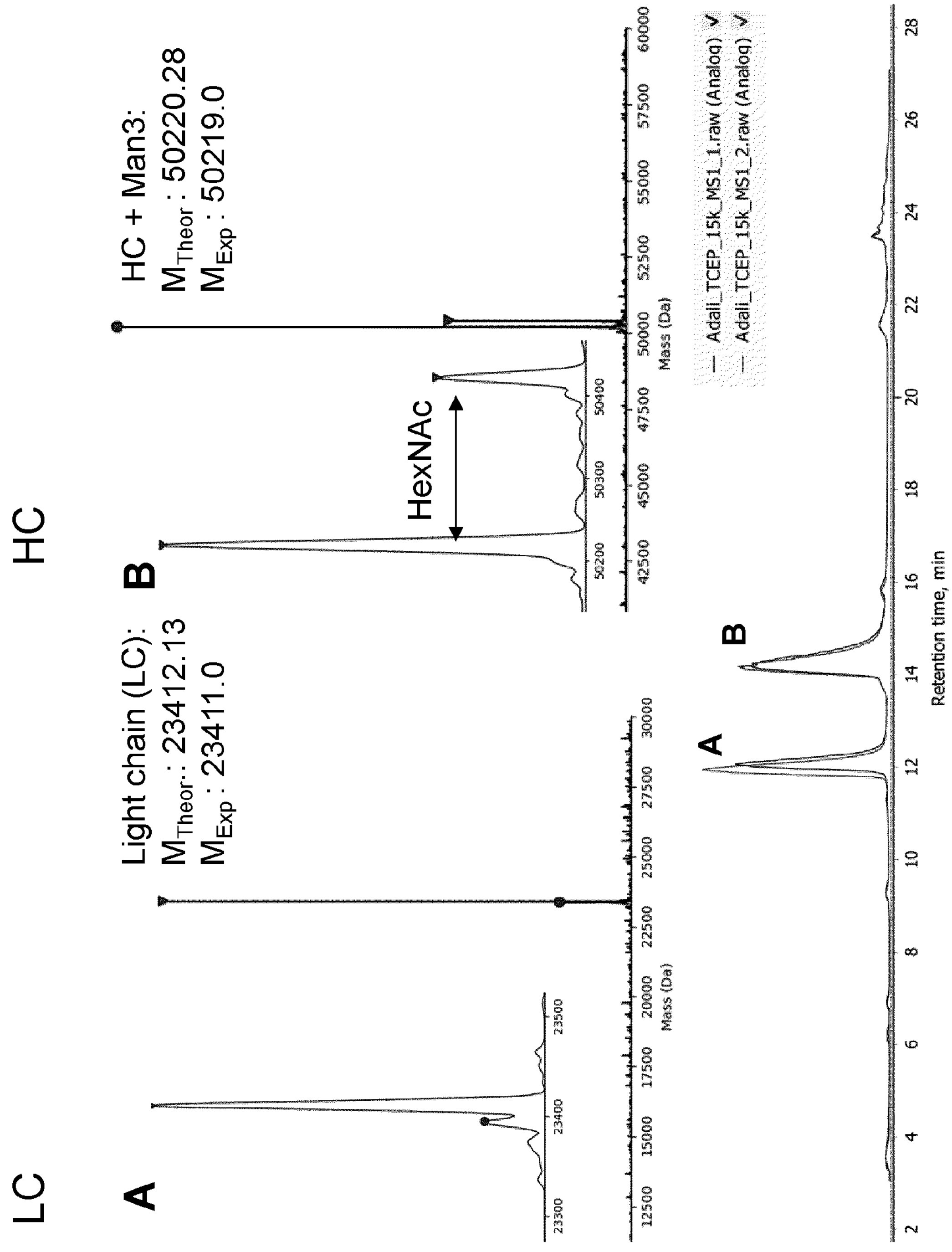

Intact antibody MS measurement showed the expected mass matching the N-glycosylation on the HC with Man3. However, two additional peaks were prominent, which fit to the mass increment of one or two HexNAc (FIG. 2A). In addition to the intact measurement, the antibody was reduced with TCEP or enzymatically cleaved (IdeS) to generate Fd, LC and Fc/2 subunits. Using the reduced antibody, this modification was found to be present on the heavy chain of the antibody. No HexNAc modification was observed on the light chain (FIG. 2B). The analysis of IdeS derived subunits showed that the additional HexNAc is localized on the Fd subunit of Adalimumab suggesting that either one or two heavy chains are modified with an additional HexNAc glycosylation event (FIG. 2C). These analyses indicated that the additional and unexpected HexNAc modification was located within the HC, more precisely within the Fd part.

Figure 2D:
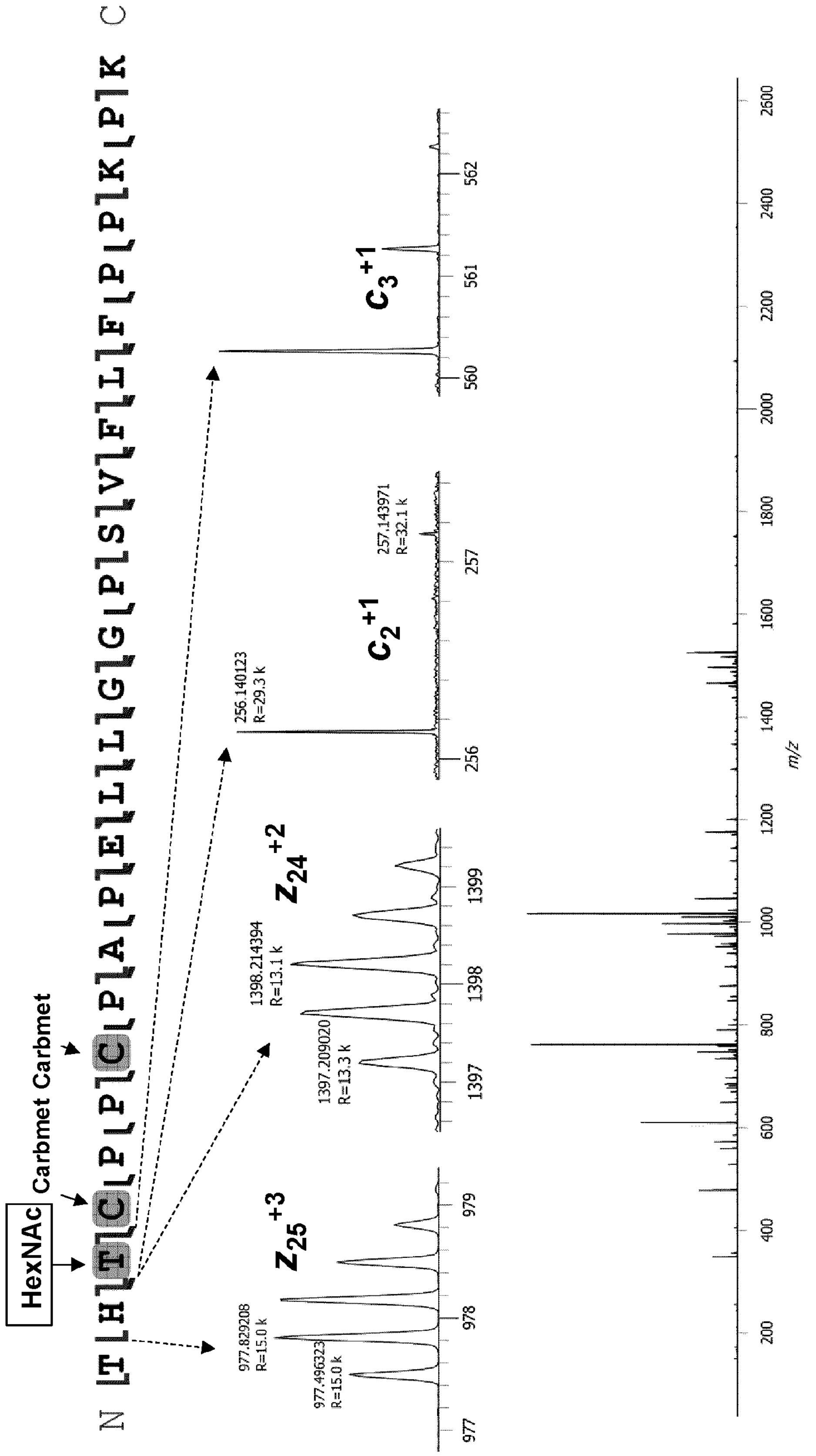

In order to identify the localization of the additional HexNAc modification observed on the Fd subunit of Adalimumab, a bottom-up proteomics approach using trypsin and chymotrypsin digests and HCD and ETD fragmentation was carried out employing the state-of-the-art Orbitrap FTMS instrumentation, first untargeted and additionally targeted against the most promising peptides. These results clearly indicated a HexNAc modification of a threonine within a peptide of the hinge area of the heavy chain: THTCPPCPAPELLGGPSVFLFPPKPK (SEQ ID NO:227) with the O-HexNAc attached to a Threonine (bold and underlined), corresponding to the Thr225 (EU numbering) (FIG. 2D). Such modification (O-glycosylation) was previously suggested in the mAb literature (Plomp, et al. (2015) Mol Cell Proteomics 14 (5), pp. 1373-1384). The detected peptide shows a strong intensity, supporting the intact Fd measurements (relatively high abundance of HexNAc modified Fd). The bottom-up data suggested that two additional sites could also be O-glycosylated with HexNAc. The degree of the O-glycosylation on these sites was however very low and thus difficult to confirm. On the peptide TKPREEQYNSTYR (SEQ ID NO: 228) a HexNAc was assigned to the Tyrosine (Y) residue next to the N-glycosite. Further, on the peptide LTVDKSRWQQGNVFSCSVMHEALHNHYTQK (SEQ ID NO: 238) an O-glycosylation is likely taking place, but the exact site could not be determined.

Thus, the O-glycosylation in Adalimumab was confidently located at the Thr225 within the hinge region of the antibody.

(ii) Characterization

The HexNAc modification found on Adalimumab produced by LimmaTech Biologics' CustomGlycan platform was subjected to specific analyses to address the identity, more specifically, whether it corresponds to an N-acetylglucosamine (GlcNAc), N-acetylgalactosamine (GalNAc) or N-acetylmannosamine (ManNAc). For this purpose two different approaches were used, first, the monosaccharide analysis by high performance anion exchange chromatography coupled with pulsed amperometric detection (HPAEC-PAD) and secondly, by MS LC-MS/MS analysis.

(A) Monosaccharide Analysis by High Performance Anion Exchange Chromatography Coupled with Pulsed Amperometric Detection (HPAEC-PAD).

To approach the identity by different methods, the Adalimumab was first characterized for the O-HexNAc by monosaccharide analysis by high performance anion exchange chromatography coupled with pulsed amperometric detection, HPAEC-PAD. For identifying the nature of the O-HexNAc found on T225 of the heavy chain of Adalimumab, a 14 amino acid glycopeptide was generated using FabRICATOR (IdeS) and GingisKHAN (Kgp) following the product manuals in combination with several purification steps.

TFA was used for hydrolysis of HexNAc from the mAb; during TFA treatment the N-Ac is lost and the respective amino-sugar is generated. On the HPAEC the standards GlcNAc, GalNAc and ManNAc, which were also treated with TFA, were chromatographically well separated. In the hydrolyzed Adalimumab sample three peaks were observed with low intensities, two of which were also present in the buffer control and the hydrolysis of the commercial Humira®, not carrying an O-HexNAc. The third peak (RT 9.767 min) in the Adalimumab sample was not present in the controls and eluted at a similar RT as the TFA treated GlcNAc standard, however with a slightly shifted in RT (RT 9.95). Spiking the treated GlcNAc standard in a hydrolyzed Adalimumab sample showed that the slight shift originates from the difference of the matrix between the hydrolyzed sample and the standard and it could thus be hypothesized that the HexNAc present on Adalimumab is a GlcNAc (FIGS. 3A-3B).

(B) Identity of O-HexNAc Characterized by MS Fragmentation

To check for the identity of the O-HexNAc, a targeted method was applied in which additional MS/MS events of an ion were triggered once the initial MS/MS scan of this ion shows the characteristic HexNAc oxonium ion at m/z 204.087. It has previously been demonstrated that this pattern of oxonium ions can be used to discriminate between a GalNAc and a GlcNAc (Halim et al. (2014) J Proteome Res 13 (12), pp. 6024-6032). Especially the ratio between the intensities of the ions at m/z 138.055 and m/z 144.066 is very different between a GalNAc and a GlcNAc.

First, the specific tryptic peptide (THTCPPCPAPELLGGPSVFLFPPKPK) (SEQ ID NO: 227) with the HexNAc modification was identified. The calculated m/z of this peptide is 762.6397 ($[M+4H]^{4+}$). This peptide was found in the Adalimumab samples (eluting around 29.2 min) but not in the commercial control (Humira®) samples, confirming that this single HexNAc modification is unique for the Adalimumab derived from CustomGlycan host cells. As an internal reference, the species at m/z 1467.0175 ($[M+3H]^{3+}$) was used, which eluted around 35.2 minutes in all samples.

Subsequently, the glycopeptides were looked up in each run by checking for the presence of the characteristic HexNAc oxonium ion at m/z 204.087 in the high collision dissociation (HCD) MS/MS data. Also the tryptic glycopeptides containing the conserved N-glycosylation site in the heavy chain could be observed.

The samples were then analyzed with a more targeted LC-MS/MS method where additional MS/MS events of an ion was triggered once the initial MS/MS scan of this ion showed the characteristic HexNAc oxonium ion at m/z 204.087. For these additional MS/MS experiments, different collision energies were used (HCD normalized collision energies, NCE, of 32, 37 and 42%) and a higher number of ions were selected for fragmentation.

Previous experiments using electron transfer dissociation (ETD) demonstrated that the HexNAc is present on Thr-3 within the following tryptic peptide containing the HexNAc (THTCPPCPAPELLGGPSVFLFPPKPK+HexNAc) (SEQ ID NO:227). Using HCD for fragmentation, ions that lost the HexNAc (as neutral loss ions) are primarily observed. To investigate the identity of the HexNAc, the relative intensity of the HexNAc oxonium ions (Table 7) in the low mass region of the MS/MS spectra were evaluated.

TABLE 7

HexNAc oxonium ions.

| Name | m/z | Composition |
|---|---|---|
| HexNAc | 204.087 | [C8H14NO5]+ |
| HexNAc-H20 | 186.076 | [C8H12NO4]+ |
| HexNAc-2H2O | 168.066 | [C8H10NO3]+ |
| HexNAc-C2H4O2 | 144.066 | [C6H10NO3]+ |
| HexNAc-CH6O3 | 138.055 | [C7H8NO2]+ |
| HexNAc-C2H6O3 | 126.055 | [C6H7NO2]+ |

In FIG. 4A, the pattern of HexNAc oxonium ions is shown for the tryptic peptide (THTCPPCPAPELLGGPSVFLFPPKPK) (SEQ ID NO:227) carrying the HexNAc (m/z 762.641), acquired at an NCE of 32%. (The patterns at NCE's of 37 and 42% are not shown). A similar pattern was also observed in the fragmentation spectra of the tryptic peptide with one missed cleavage (SCDKTHTCPPCPAPELLGGPSVFLFPPKPK) (SEQ ID NO:239) and the HexNAc (data not shown).

Previously, it was demonstrated that the Adalimumab contains a homogeneous glycan on the conserved N-glycosylation site within the tryptic peptide EEQYNSTYR (SEQ ID NO: 228). The fragmentation spectrum of this peptide carrying a glycan structure composed of GlcNAc2Man3 was also analyzed (m/z 1041.4221 [M+2H]2+). As expected, the pattern of the HexNAc oxonium ions (low intensity of the ion at m/z 144 compared to that of the ion at m/z 138) in this MS/MS spectrum matches with that of a GlcNAc (FIG. 4B). Moreover, the value integrating the intensities of the ions at m/z 138.055 and 168.066 and the ions at m/z 126.055 and 144.066, as described above, was 3.8 in this spectrum.

As a reference to a peptide carrying a GalNAc, which was measured with the same method on the same instrument in previous experiments, the pattern of HexNAc oxonium ions for a peptide from CD43 (MoxYTTSITSDPK) (SEQ ID NO:229) carrying three GalNAc is shown in FIG. 4C.

Based on the pattern observed in FIG. 4A, especially the low intensity of the ion at m/z 144 compared to that at m/z 138, it is highly likely that the HexNAc on this peptide in the Adalimumab sample is a GlcNAc. This is further supported by the numerical value displaying the combined intensities of the ions at m/z 138.055 and 168.066 divided by the combined intensities of the ions at m/z 126.055 and 144.066. In the paper by Halim et al (Halim et al. (2014) J Proteome Res 13 (12), pp. 6024-6032), it was shown that for peptides with a GlcNAc, this value was >2. For the spectrum shown in FIG. 4A this value is 2.6. On the contrary, a value of 0.6 was found in the spectrum with the GalNAc in FIG. 4C, in line with the study by Halim et al.

Taken together, these complementary data unambiguously identified an O-linked GlcNAc to the Threonine 225 (EU numbering) within IgG1 hinge area of the heavy chain of Adalimumab produced by CustomGlycan host cells.

6.2 Example 2—Bioinformatic Screen and Analysis of OGNT Candidate Genes in *Leishmania tarentolae*

In eukaryotes, all types of O-glycosylation are initiated by distinct polypeptide glycosyltransferases, and most glycans are further elongated/branched and capped in the Golgi by sequential addition of monosaccharides directed by distinct and/or common enzymes (Joshi, et al (2018) Cell 172 (3), 632-632.e2). An O-glycan (O-linked oligosaccharide) in vertebrates is frequently linked to the polypeptide via N-acetyl galactosamine (GalNAc) to a hydroxyl group of a serine or threonine residue and can be extended into different structural core classes.

The main problem in identifying an O-glycosyltransferase ("OGT" or "OGNT") is that there seems to be no unique identifying feature that generally separates OGT from common glycosyltransferases ("GTs"). One may rely on homology to known O-glycosyltransferases.

In humans, there is a wide range of OGTs known transferring GalNAc, Man, Fuc, Glc, Xylose and GlcNAc (Bennett et al. (2012) Glycobiology 22 (6), pp. 736-756), but there were no homologues found in *Leishmania tarentolae.*

In addition, some more exotic OGT candidates in KEGG were evaluated and screened against the LTAR genome. 1) For KEGG orthology K09667, protein O-GlcNAc transferase, the representative of this family, the human OGT (Uniprot: 015294) gave several matches, but likely due to coincidental congruence of their secondary structure. The relevant active protein domain is PF13844 (GT family 41 as described by PFAM) but there were no matches in *L. tarentolae* to this domain. 2) For K18134, protein O-GlcNAc transferase, the representative of this family human EOGT (Uniprot: Q5NDL2), which transfers a single N-acetyl glucosamine from UDP-GlcNAc to a serine or threonine residue in proteins and specifically glycosylates the Thr residue located between the fifth and sixth conserved cysteines of folded EGF-like domains, there was one match in *L. tarentolae* genome that show the same GT-family-domain: LTAR_110011600, but there were no reverse hits back to the human enzyme, so this was not further regarded. 3) For COLGALT2 (human Gal OGT, transfers beta-galactose to hydroxylysine residues on collagen) there were also two matches: LTAR 130014000; LTAR360049600. The reverse hits matched back to COLGALT2. However they share the GT25 family domain, which is very broadly defined.

Importantly, candidates were found to be homologues to OGNT-1, OGNT-2, OGNT-L, which are characterized *Trypanosoma cruzi* GlcNAc O-glycosyltransferases (Heise, et al. (2009) Glycobiology 19 (8), pp. 918-933). Based on these *T. cruzi* sequences, homologues were identified and confirmed by reciprocal best hits (phmmer v3.1b; Table 8 and FIG. 5A)

TABLE 8

| Identification of *L. tarentolae* OGNT candidate genes. | | | | |
|---|---|---|---|---|
| Reference | | Best hit | E-value | Reciprocal best hit |
| TcOGNT2-1 | Tc00.1047053511309.70 | LTAR 170020900.1 | 5.20E−106 | Yes |
| TcOGNT2-2 | Tc00.1047053511759.30 | LTAR 170020900.1 | 1.70E−105 | Yes |
| TcOGNT1-1 | Tc00.1047053503511.10 | LTAR 020006800.1 | 9.00E−116 | Yes |
| TcOGNT1-2 | Tc00.1047053508741.340 | LTAR 020006800.1 | 1.70E−115 | Yes |
| TcOGNT-L-1 | Tc00.1047053503509.10 | LTAR 020006900.1 | 4.90E−27 | Yes |
| TcOGNT-L-2 | Tc00.1047053508741.360 | LTAR 020006900.1 | 5.30E−27 | Yes |

We therefore focused on the closely related *Trypanosoma* enzymes that were biochemically well characterized to transfer GlcNAc. The biosynthesis of O-glycans in mucins in *T. cruzi* initiates with the addition of a GlcNAc residue from UDP-GlcNAc (the activated sugar donor) to serine or threonine residues in the protein by a uridine diphospho-N-acetylglucosamine: polypeptide-α-N-acetylglucosaminyl-transferase (ppGlcNAc-transferase) (Previato, et al (1998) Journal of Biological Chemistry 273 (24), pp. 14982-14988). This reaction represents a major difference between O-glycosylation in *T. cruzi* and mammals. In mammals the orthologue enzyme is an UDP-GalNAc transferase that transfers N-acetyl galactosamine (GalNAc) from UDP-GalNAc to the peptide (Hagen (2002) Glycobiology 13 (1), 1R-16). This difference may have been originated by the fact that *T. cruzi* is incapable of interconverting UDP-GlcNAc to UDP-GalNAc (Roper, et al (2002) Proc Natl Acad Sci USA 99 (9), pp. 5884-5889). The *T. cruzi* enzyme, in common with most glycosyltransferases, requires divalent metal cations for activity, with Mn2+ being the most effective. This is in contrast to the human cytosolic O-GlcNAc-transferase, which shows no metal ion dependence. Most strikingly, the *T. cruzi* enzyme attaches GlcNAc to the hydroxylated amino acid via an alpha-linkage, whereas the anomeric specificity of the cytosolic enzyme is beta (Previato, et al (1998) Journal of Biological Chemistry 273 (24), pp. 14982-14988). A TcOGNT-2 gene that encodes a ppGlcNAc-transferase activity was also described in *T. cruzi*. Enzymatic analysis showed high levels of UDP-GlcNAc transferase and UDP-GlcNAc hydrolase activities, both specific for UDP-GlcNAc (Heise, et al. (2009) Glycobiology 19 (8), pp. 918-933). The peptide preference and the optimum pH are comparable to the native GlcNAc-transferase activity previously reported in *T. cruzi* microsomal fraction (Previato, et al (1998) Journal of Biological Chemistry 273 (24), pp. 14982-14988).

We also assessed the sequence features of the OGNT homologues identified in the *L. tarentolae* genome using sequence alignments to human GalNAcT1 (UniProt ID Q10472), which with OGNT-1 did not lead to meaningful results. However, for OGNT-2 with human GalNAcT1, the catalytic residues for Mn2+ coordination and UDP-GalNAc binding seem to be conserved in OGNT-2. A structure prediction with Phyre for the three OGNT candidates was performed and the resulting hits for OGNT-1 and OGNT-2 comprise different members of the UDP-GalNAc polypeptide GalNAc transferase family (GalNAc T1, T2, T4, T10 and PGANT9). Of OGNT-2 223 residues (35% of the sequence) were modelled with 99.0% confidence by the single highest scoring template. No meaningful hits were identified for OGNT-L.

By InterProScan following regions were identified:

OGNT-2 (638 amino acids, 72.2 kDa): IPR021067; Family: GlcNAc (PF11397 aa 160-316) that share a GT-A fold. Phobius combined transmembrane (TM) and signal peptide (SP) predictor for aa 1-28 cytoplasmic, 29-50 TM, 51-638 non-cytoplasmic.

OGNT-1 (1136 amino acids, 124.8 kDa): IPR021067; Family: GlcNAc (PF11397 aa 742-1121) that share a GT-A fold. Phobius aa 1-302 non-cytoplasmic, 303-325 TM, 326-1136 cytoplasmic. OGNT-1 has also signatures to the Nucleotide-diphospho-sugar transferases (IPR029044) superfamily.

OGNT-L (1136 amino acids, 124.4 kDa): IPR021067; Family: GlcNAc (PF11397) that share a GT-A fold. Phobius 1-20 cytoplasmic, 21-42 TM, 43-1136 non-cytoplasmic.

Additionally, the available proteomes of 96 isolates from the TriTryp database (release 44) were analyzed to identify OGNT homologues in other Kinetoplastida. The search for OGNT variants used *T. cruzi* OGNTs as reference, the hits were tested by reciprocal best hits on *L. tarentolae* genome, indicating meaningful hits for 47 Kinetoplastida (dated September 2019). For each species, one representative isolate has been chosen and a total of 81 sequences were used to build a phylogenetic tree by multiple sequence alignment using T-coffee and RAXML (FIGS. 5B and 5C)

Next, phenotypic effects or even lethality upon deletions of the O-glycosylation enzymes were considered. Interestingly, a high-throughput phenotyping approach termed RNA interference target sequencing, or RIT-seq, could map fitness-costs associated with RNAi in *Trypanosoma brucei* (Alsford et al. (2011) Genome research 21 (6), pp. 915-924). In *T. brucei* RNAi against the OGNT-2 (Tb927.5.2350) and OGNT-1 (Tb927.2.2400) was associated with loss-of-fitness in individual samples, which hints these enzymes are not essential, but suggests that double knock-out is potentially harmful for cells. OGNT-L (Tb927.2.2380), described as being inactive, does not seem to be essential in *T. brucei*. Single knock-out and especially heterozygous mutations were therefore expected to lead to viable mutants in *L. tarentolae* cells.

6.3 Example 3—Controlling O-HexNAc Levels on mAb by Targeted Deletions

Methods and Compositions of Knock Out (KO) Host Cells

Deletions of the OGNT candidates in *Leishmania tarentolae* were performed by homologous recombination of DNA constructs into the untranslated regions flanking the coding sequence of the respective gene. Due to the tandem organization of OGNT-L and OGNT-1 on chromosome 2 (FIG. 5A and FIG. 6) the two ORFs could also be targeted simultaneously. For this, integration constructs were synthesized that contain a selection marker that ultimately replaces the OGNT coding sequence (CDS) and can be used to select for positive transfectants. Three different versions of integration constructs were used:

Replacement with a selection marker flanked by 5' and 3' untranslated regions providing it with defined splice leader acceptor and polyadenylation sequences (transcription by endogenous PolII).

Replacement with a selection marker without flanking untranslated regions (transcription by endogenous PolII). These constructs receive the spliced leader acceptor and polyadenylation sequences from the endogenous OGNT 3' and 5' UTRs.

Replacement with an expression cassette for glycoengineering that is integrated in counterclockwise orientation and equipped with a promoter region for PolI transcription and untranslated regions providing spliced leader addition as well as polyadenylation sequences to the gene(s) of interest.

The genetic integration constructs described above are split into two DNA fragments within the coding sequence of the selection marker, leaving an overlap of 200 bp for homologous recombination between the two fragments. This was necessary to avoid expression of the selection marker from the plasmid (episome) and thus false positive transfectants.

DNA fragments were prepared for transfection by restriction digest of the cloning plasmids and mixing of the fragments in the appropriate combinations. Transfection was standardly performed using the 4D-Nucleofector™ Core X.

Transfection of the DNA fragments for replacement of the OGNT-2 gene by homologous recombination generated positive transfectants that were able to grow in the respective selection antibiotic. PCR analysis on crude DNA preparations revealed that one allele of OGNT-2 was replaced by the selection marker construct, while another wild type allele remained (heterozygous KO, data not shown). Attempts to create homozygous knock-outs by either raising the selection marker concentration or transfection of a second construct carrying a different selection marker were not successful. Since high throughput RNAi screens had indicated non-lethality but potential growth defects under certain conditions for the homologous genes in *T. brucei*, achievement of homologous OGNT knock-outs might be complicated by growth impairment of the transfectants.

Thus, due to the high efficiency of double strand break formation by CRISPR/Cas9 and the assumption that homology mediated repair is the main DNA repair mechanism in *Leishmania* (Zhang and Matlashewski (2015) M Bio 6 (4), e00861; Duncan et al (2017) Molecular and Biochemical Parasitology 216, pp. 30-38), it was attempted to achieve homozygous knock-outs by this mechanism, which had previously been used in other *Leishmania* species (Beneke, et al (2017) R. Soc. open sci. 4 (5), p. 170095; Ishemgulova (2018) PloS one 13 (2), e0192723; Peng, et al (2015) mBio 6 (1), p. 409; Fernandez-Prada, et al (2018) International Journal for Parasitology: Drugs and Drug Resistance 8 (2), pp. 165-173). For this, a 3×flag-hCas9 expression construct containing a nuclear localization signal (Le, et al. (2013) Science 339 (6121), pp. 819-823) was transfected episomally into St10569. The resulting strain St15392 was subsequently transfected with a mixture of guide RNAs (gRNA) and the DNA fragments for replacement of the individual OGNT genes by selection marker integration (flanked by IRs). To confirm the absence of the OGNT genes in these strains (St16248 OGNT-2 KO; St16257 OGNT-1 KO; St6249 OGNT-L KO), were sequenced on Illumina NextSeq. High genomic coverage was achieved and thus the complete absence of reads matching to the respective OGNT region indicated a successful and complete removal of the respective OGNT gene for all three strains (FIG. 7A). Alternative to sequencing, PCR analysis can be used to confirm homozygous knock-out of the respective OGNT genes (see representative figure in example 6, FIG. 9D).

In order to analyze whether the knockout of any of these genes is sufficient to prevent O-glycosylation of the Adalimumab hinge region, individual knock-out strains were engineered that co-express Adalimumab from the ssu locus. Additionally, a cell line was created where the tandemly arranged OGNT-L and OGNT-1 genes were replaced simultaneously by a selection marker integration construct. For this, the homologous recombination sites and gRNAs targeting the 5' end of OGNT-L and the 3' end of OGNT-1 were combined.

From the resulting cell lines (St16478 OGNT-2 KO+Adalimumab; St16700 OGNT-1 KO+Adalimumab, St16702 OGNT-L KO+Adalimumab; St16704 OGNT-1+L KO+Adalimumab), Adalimumab was enriched by ProteinA affinity chromatography and subjected to MALDI based relative O-HexNAc quantification. In preparation for the MALDI based relative O-HexNAc quantification, Adalimumab is subjected to a double digest with FabRICATOR and GingisKHAN during which a 14 aa peptide with the sequence THTCPPCPAPELLG (SEQ ID NO:230) is produced that includes the O-glycosylation site of the IgG hinge region.

MALDI spectra obtained after the FabRICATOR/GingisKHAN double digest were analyzed and the relative abundances of unglycosylated and O-glycosylated versions of the same peptide were determined by integrating the areas of the monoisotopic masses of the H+ and Nations and relating the summed intensities of all identified peptide forms. Although the MALDI can be considered suitable for a relative quantification of the modified and unmodified peptide, the absolute intensities obtained and the noise level might differ between samples due to differences in quality of the crystals formed during spotting on the target. Therefore, samples where O-HexNAc is expected at low levels might lead to a positive confirmation in some cases and for weaker spots not lead to a confirmation due to changes in the signal-to noise level. Therefore, for some of the KO lines O-HexNAc levels were determined also by the targeted glycopeptide analysis or subunit analysis. Table 3 summarizes the obtained results.

While for the OGNT-2 KO 15.8% of the hinge region peptides were still found to be modified with an O-HexNAc, no O-HexNAc modification could be detected on the antibodies prepared from the OGNT-1 KO and OGNT-L KO cell lines. However, in the samples generated from the simultaneous OGNT-1+L KO cell line 0.3% of the peptides were still carrying the O-HexNAc modification. To further assess the amount of the O-HexNAc modification by a more sensitive method, the purified antibodies of the OGNT-1 KO and the OGNT-1+L KO were additionally analyzed by peptide mapping. In these measurements, both strains were found to have almost undetectable remaining O-HexNAc modified hinge regions with around 0.04-0.05%.

Since the remaining OGNT-2 gene in the OGNT-1+L KO cell line could be responsible for the residual modifications, a triple KO cell line was generated by transfection of the construct for simultaneous OGNT-1+L knock-out into the previously produced OGNT-2 KO strain (St16478). The resulting strain St16636 was confirmed by Illumina NextSeq to have all three OGNT genes knocked out (FIG. 7B).

In FIG. 8A MALDI spectra from the FabRICATOR/GingisKHAN double digest are shown for a wt background and a triple KO, respectively. While in the wt background the unmodified 14 aa peptide and the peptide with a HexNAc modification was observed, only the unmodified 14 aa peptide was present for the KO line. Additionally, confirmatory targeted glycopeptide analysis was performed to confirm the absence of the O-HexNAc modification. In FIG. 8B the selected ion chromatograms (SIC) of the peptide THTCPPCPAPELLGGPSVFLFPPKPK (SEQ ID NO:227) (+2*carbamidomethylation) with and without O-HexNAc are shown for the triple KO line, that was subjected to a tryptic digest and measured with a very sensitive ESI-LC-MS method (Orbitrap FTMS system). While the SIC for the peptide without HexNAc modification showed a good signal, no signal could be confirmed for the peptide with modification, confirming the hypothesis that a knock-out of all three OGNT candidate genes can completely abolish unwanted O-glycosylation on IgG. No other O-HexNAc modification was found in a search for the peptide data. For Adalimumab expressed in CustomGlycan host cells without the OGNT knockout a signal was obtained for the SIC of the peptide THTCPPCPAPELLGGPSVFLFPPKPK (SEQ ID NO:227) (+2*carbamidomethylation) with and without O-HexNAc modification.

For the generation of all previously mentioned strains, integration constructs were used that integrated the selection markers flanked by additional untranslated regions to ensure proper expression. Next it was tested whether these can be omitted and the selection markers can be expressed under the control of the native OGNT UTRs. For this, an integration construct containing only the selection marker coding sequence flanked by homologous recombination sites for the 5' intergenic region of OGNT-L and the 3' intergenic region of OGNT-1 was transfected into a strain that co-expresses 3×flag-hCas9 and Adalimumab (St16569). Correct replacement of the OGNT-1 and OGNT-L genes in the resulting strain (St16770) was confirmed by PCR and the antibody prepared from this strain was analyzed by MALDI. As in the OGNT-1+L KO cell line that was produced with additional intergenic regions (St16704), the strain without these intergenic regions was found to contain only low amounts of O-HexNAc modified hinge peptides (0.2-0.3%). This confirms that the integration of additional intergenic regions can be omitted for the creation of OGNT KO cell lines.

Since the CRISPR/Cas9 based knock-out strategy reproducibly produced homozygous knock-out of the individual or tandemly arranged genes, it was next attempted to create a knock-out of all three candidate genes at once by including the gRNAs and homologous recombination constructs targeting the 5' and 3' ends of OGNT-2 as well as the 5' end of OGNT-L and the 3' end of OGNT-1 into the transfection of the Adalimumab, 3×flag-hCas9 co-expressing strain (St16872, cas9 episomal). In this case, the same selection marker was used to target both loci and integration constructs without additional intergenic regions were used. The transfection successfully obtained viable clones that were by PCR confirmed to have all OGNT genes replaced by the selection marker. MALDI based analysis of Adalimumab purified from this strain St17127 confirmed the functional knock-out of all three OGNT genes by the absence of detectable HexNAc modification.

Taken together, complete OGNT deletion cell lines were generated that show complete absence of O-glycans within the recombinant Adalimumab, making these host cells ideal for manufacturing recombinant antibodies or antibody formats devoid of unwanted modifications.

TABLE 9

Summary of O-HexNAc quantification of OGNT deletion strains.

| Strain | Strain number | Illumina Sequencing | Rel. O-HexNAc % (MALDI) | Rel. O-HexNAc % (subunit analysis or * targeted glyco-peptide) |
|---|---|---|---|---|
| Wt Adalimumab | St15449 | n.a. | 20.9-21.7 | 17.4 |
| OGNT-2 KO | St16248 | Confirmed | n.a. | n.a. |
| OGNT-1 KO | St16257 | Confirmed | n.a. | n.a. |
| OGNT-L KO | St16249 | Confirmed | n.a. | n.a. |
| OGNT-2 KO Adalimumab | St16478 | confirmed for parental (St16248) | 15.8 | 19.4 |
| OGNT-1 KO Adalimumab | St16700 | Confirmed | 0 (n.d.) | 0.04* |
| OGNT-L KO Adalimumab | St16702 | Confirmed | 0 (n.d.) | n.a. |
| Double OGNT-1/L KO Adalimumab | St16704 | Confirmed | 0#-0.3 | 0.05* |
| Double OGNT-1/L KO (no IR) Adalimumab | St16770 | n.a. | 0.3 | n.a. |
| Triple OGNT-1/2/L KO Adalimumab | St16636 | Confirmed | 0# (n.d.) | 0 (n.d.)* |
| Triple OGNT-1/2/L KO (no IR) Adalimumab | St17127 | n.a. | 0 (n.d.) | n.a. |
| Triple OGNT-1/2/L KO Adalimumab G0 N-glycan cell ine | St17863 | n.a. | 0 (n.d.) | n.a. |
| Triple OGNT-1/2/L KO Adalimumab G2 N-glycan cell line | St17317/ St17318 | n.a. | 0 (n.d.) | n.a. |
| OGNT-1/L::G0 Adalimumab G0 N-glycan cell line | St17846 | n.a. | 7 | n.a. |

n.a. = not available (no measurement performed);
n.d. = not detected,
*targeted glycopeptide analysis,
#data (additionally) measured for fed-batch fermentation derived Adalimumab.

6.4 Example 4-Controlling O-HexNAc Levels on mAb by Overexpression of OGNTs

To assess the effect of overexpression on the three OGNT candidates, DNA fragments were generated that contained the respective triple HA tagged OGNT genes as well as the selection marker “ble” flanked by intergenic regions (aprt 5' UTR, CamIR, dhfr-ts 3'UTR) to support stable expression. The extremities of the constructs contained homologous recombination sites for the ssu locus which is known to support high level protein expression. The linearized constructs (p5932, p5933, p5934) were transfected into a strain that expresses Adalimumab (also ssu locus, St15449). By Western blot it could be confirmed that the resulting strains were expressing either OGNT-2_3×HA (St15884), OGNT-1_3×HA (St15885) or OGNT-L_3×HA (St15886) as expected. Next, Adalimumab was enriched from these strains by Protein A affinity chromatography and the O-HexNAc level was quantified by subunit analysis. While the OGNT-L overexpression strain exhibited almost wild type O-HexNAc modification levels on Adalimumab, both OGNT-1 and OGNT-2 overexpressing strains performed less O-glycosylation on the Adalimumab hinge region. This effect was very pronounced in the OGNT-1 overexpression strain where the O-HexNAc amount was 10× reduced to 1.9% compared to the wt control derived Adalimumab (Table 4). Without further analysis one might speculate that this effect results from a regulation by self-glycosylation as protein primary sequence contains a stretch of THT repeats. Alternatively, another hypothesis could be based on Heise (Heise, et al. (2009) Glycobiology 19 (8), pp. 918-933), who described that OGNT-1 has not only transferase but also hydrolysis activity on UDP-GlcNAc, causing UDP-GlcNAc breakdown if there is a lower peptide concentration (less protein substrate). One might expect that OGNT-1 overexpression, while the protein substrate concentration stays the same, shifts the OGNT-1 activity to hydrolysis of UDP-GlcNAc so UDP-GlcNAc might be depleted in the cell. However, these hypotheses warrant further investigation.

In conclusion, modification of OGNT variant expression levels can be used to tune and reduce the O-glycosylation levels in *L. tarentolae*.

TABLE 10

Summary of O-HexNAc quantification of OGNT overexpression strains.

| Strain | Strain number | Illumina Sequencing | Rel. O-HexNAc % (MALDI) | Rel. O-HexNAc % (subunit analysis) |
|---|---|---|---|---|
| wt Adalimumab | St15449 | n.a. | 20.9-21.7 | 17.4 |
| OGNT-2 OE Adalimumab | St15884 | n.a. | n.a. | 8.5 |
| OGNT-1 OE Adalimumab | St15885 | n.a. | n.a. | 1.9 |
| OGNT-L OE Adalimumab | St15886 | n.a. | n.a. | 13.2 |
| OGNT-1 OE Adalimumab G0 N-glycan cell line | St16292 | n.a. | 2.8 | 1.5 |

n.a. = not available (no measurement performed)

6.5 Example 5-No Phenotypic Impact of OGNT Deletion Strains-Growth in Bioreactor To analyze if there was a phenotypic impact of OGNT deletion strains St16704 (OGNT-1/L KO) and St16636 (OGNT-1/2/L KO) were subjected to fed-batch fermentations. Both strains exhibited stable growth in the bioreactor and reached maximum ODs of 18 and 20 at the end of fermentation. This is fully comparable to strains with wild type OGNT genotype such as St12427 grown under the same conditions. Furthermore, full length antibody could be isolated by Protein A enrichment from the supernatant after fermentation and was subjected to MALDI based relative O-HexNAc quantification. In both samples, the O-HexNAc modified peptide was not detectable (Table 9). Thus, knock-out of OGNTs depletes the O-HexNAc modification independent of the culture scale and has no effect on growth during fermentation.

Figure 9A:
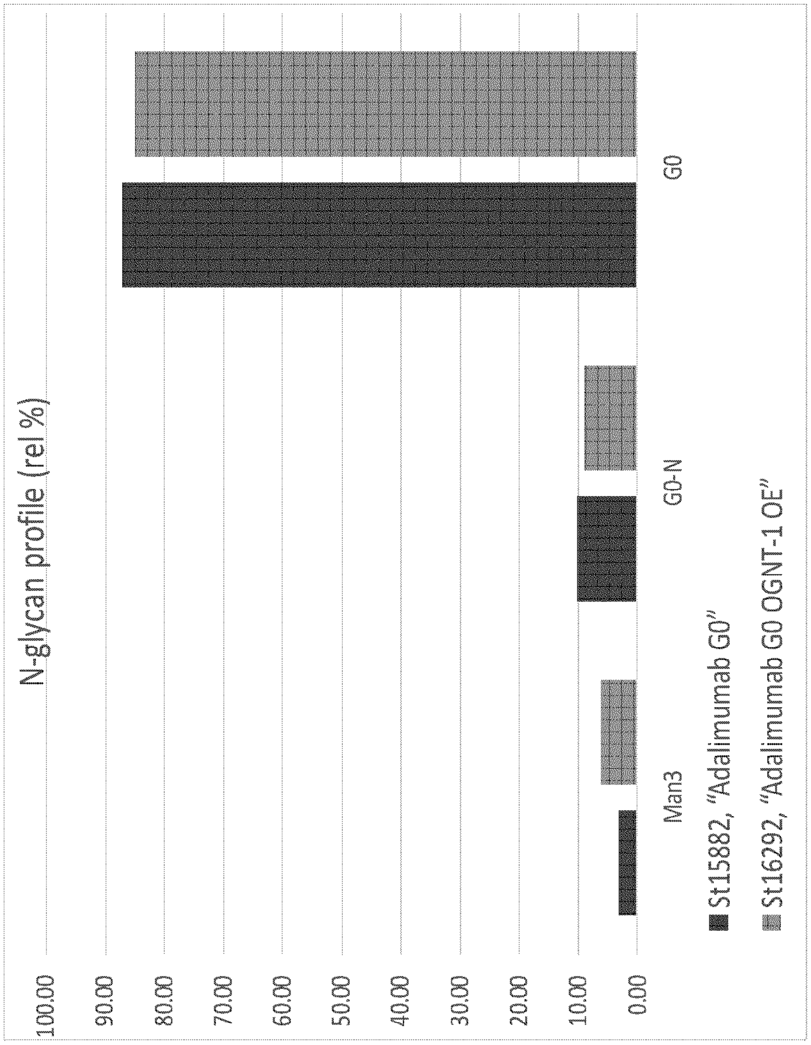

6.6 Example 6—No Phenotypic Impact of OGNT Deletion and Overexpression on N-Glycan Engineering Overexpression In order to identify whether OGNT overexpression has an effect on other strain modifications such as N-glycan engineering, a strain expressing Adalimumab and the glycosyltransferases sfGnt1, rnMGAT2 and drMGAT1 (St15882, "Adalimumab G0") was transfected with SmiI linearized plasmid pLMTB5933 to achieve integration of an OGNT-1 overexpression construct into the ssu locus (St16292, "Adalimumab G0 OGNT-1 OE"). The resulting strain and the parental strain were grown in 50 ml shake flask cultures and the secreted antibody was enriched via ProteinA affinity chromatography. Samples were subjected to N-glycan analysis (RFMS) as described previously and demonstrated almost identical N-glycan profiles. Thus, the overexpression of OGNT-1 does not affect the expression and function of glycosyltransferases modifying the N-glycan on Adalimumab (FIG. 9A).

Knock-Out

Figure 9B:
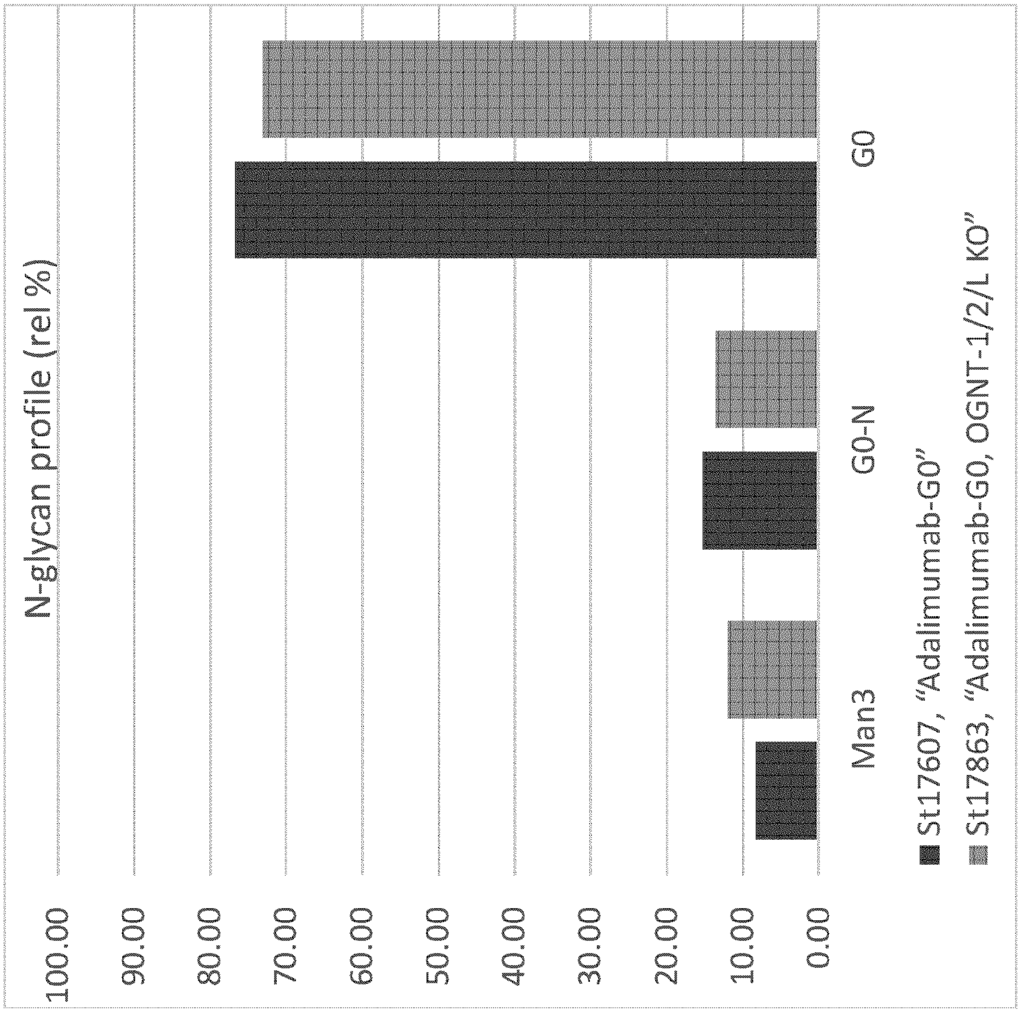
Figure 9C:
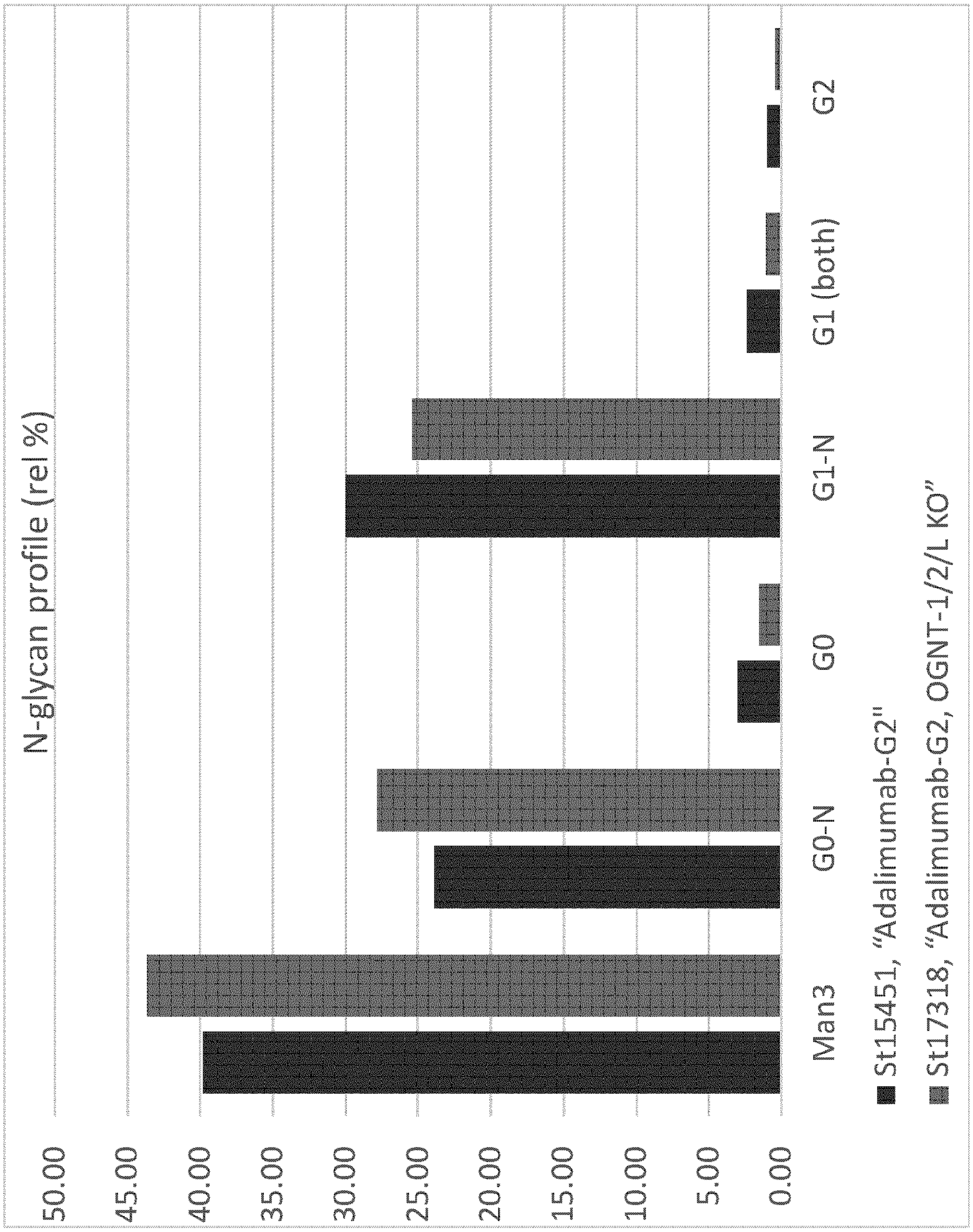
Figure 9D:
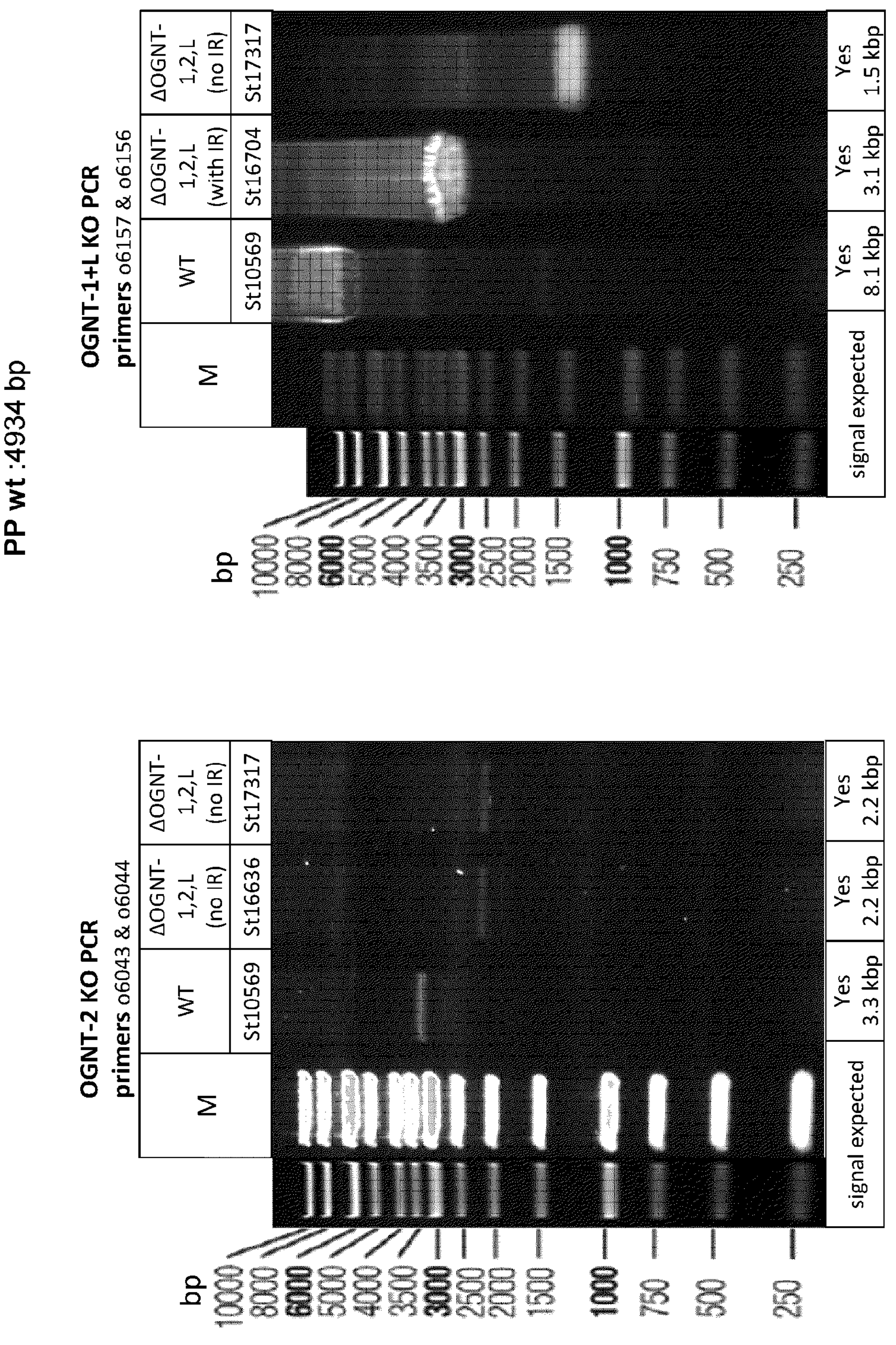

To assess the effect of OGNT deletion on the expression and function of N-glycan modifying enzymes, CRISPR/Cas9 mediated knock-out of all three OGNT candidates (1/2/L) in the background of a strain expressing Adalimumab and the glycosyltransferases sfGntI, rnMGAT2, drMGAT1 was performed. Protein A enriched Adalimumab prepared from the resulting strain St17863 ("Adalimumab-G0, OGNT-1/2/L KO") and the precursor strain St17607 ("Adalimumab-G0") was subjected to N-glycan analysis (PC-labeling) and displayed almost indistinguishable N-glycan profiles (FIG. 9B). No O-HexNAc could be detected on the purified antibody from strain St17863 by MALDI based analysis. The absence of the putative O-glycosyltransferases thus does not affect glycoengineering of N-glycans. The same was observed for a glycoengineering strain expressing sfGntI, drMGAT1, rnMGAT2 and hsB4GalT1 for N-glycan conversion up to G2 St17318 ("Adalimumab-G2, OGNT-1/2/L KO") in comparison with the precursor strain St15451 ("Adalimumab-G2") (FIG. 9C). Thus also galactosylation of N-glycans is not affected by OGNT knock-outs. In both cases, the absence of the OGNT encoding genes was assessed by PCR (see representative example in FIG. 9D).

6.7 Example 7—Replacement of OGNTs by Expression Cassette for Glycoengineering In previous examples, the OGNT coding sequences were replaced by selection markers with the intention to remove OGNT function. By this, it was found that selection marker expression can be driven from this chromosomal locus, by exploiting the native intergenic regions. In order to assess, whether the OGNT loci can also be used for functionalization of the cell, i.e. by expression of a glycoengineering construct, an Adalimumab expressing strain (St15449) was transfected with linear fragments derived from plasmids pLMTB8223, 8381, 8301, 8234, 8629, 8238, 8287, 8383, 8384, 8229. This multiple fragment assembly (as described in Provisional Application entitled "Engineered *Leishmania* Cells" filed even date herewith) targeted an expression construct for drMGAT1, drMGAT2, gjMGAT1 and agMGAT1 to the native OGNT-1/L locus on chromosome 2. The resulting strain St17846 was subjected to N-glycan analysis based on Protein A purified Adalimumab and almost homogeneous G0 glycans were detected (92%) (FIG. 10A). Furthermore, construct integration into the OGNT locus was confirmed by PCR covering the selection marker including 3' end of the integrated construct (FIG. 10B) and a relative O-HexNAc content of 7% was determined by MALDI on hinge region peptides from ProteinA enriched Adalimumab from this strain (see Table 9). Taken together, these data corroborate that we successfully replaced one of the two alleles encoding OGNT-1 and OGNT-L by a functional expression cassette for glycoengineering and thereby reduced, but not abolished the O-HexNAc modification.

6.8 Example 8-OGNT Deletion Prevents O-Glycosylation on Erythropoietin

In contrast to the unexpected O-glycosylation of the IgG hinge region, the native O-glycosylation site of rhEPO was completely modified with O-HexNAc upon expression in wildtype *L. tarentolae* (see Example 1). In order to assess whether the modification of this highly occupied native site can also be controlled by targeted knock out of the *L. tarentolae* OGNTs, strain St17785 expressing LMSAP-rhEPO-Strep was transfected with a Cas9 expression cassette (St17785) and subsequently all three OGNTs were simultaneously knocked out as described in previous examples (St17917). Upon monoclone selection, strain St18143 was obtained which was PCR positive for replacement of all OGNT genes by the selection maker neo (OGNT-1/2/L KO).

Next, LMSAP-rhEPO-Strep was enriched from the cell culture supernatant of St18143 by ammonium sulfate precipitation and StrepTrap affinity purification and subsequently analyzed by targeted peptide mapping with LC-MS. While the unglycosylated form of the peptide containing the native rhEPO O-glycosylation site was readily detected, no evidence for the presence of masses corresponding to the peptide carrying an O-HexNAc modification (FIG. 11) nor for the presence of oxonium ions originating from O-HexNAc in the expected elution time range was found (data not shown). This corroborates that with these three enzymes the true O-glycosyltransferases of *L. tarentolae* could be knocked out. Thus, the CustomGlycan Platform can be utilized to prevent unwanted O-glycosylation on mammalian target proteins.

6.9 Example 9—Improved Methods for CRISPR/Cas9 Mediated OGNT Triple Knock-Outs The above-provided method for CRISPR/Cas9 based knock-out of *Leishmania* OGNTs has proven to be very efficient. However, the procedure requires two sets of transfections for introduction of the constitutively expressed 3×flag-hCas9 and generation of the actual knock-out in any given target strain. This requires the use of two different selection markers and thus limits the possibilities for further modifications of the cell lines. Additionally, the constitutive expression of Cas9 and therefore modified host cell protein composition may be unfavorable for stable cell lines. For these reasons, knock-out generation in *L. tarentolae* by ribonucleoprotein complexes (RNP) was attempted. The above-provided CRISPR guide RNAs targeting OGNT-1, OGNT-2 and OGNT-L were complexed with recombinantly produced Cas9 protein (Alt-R® S.p. HiFi Cas9 Nuclease, Cat. No. 1081061, Integrated DNA Technologies, Inc.) and were directly transfected into the cells along with the same DNA repair constructs used for the above-provided CRISPR mediated replacements of all three OGNT genes by the same selection marker without using additional untranslated regions.

While previously high knock-out efficiencies in *Leishmania* (major) were only published for the use of SaCas9/sgRNA RNPs (Soares Medeiros, et al (2017) mBio 8: e01788-17), but not for SpCas9, we were able to reproducibly obtain full knock-outs of all three OGNT genes within a single transfection with SpCas9/gRNA RNPs.

Figure 12A:
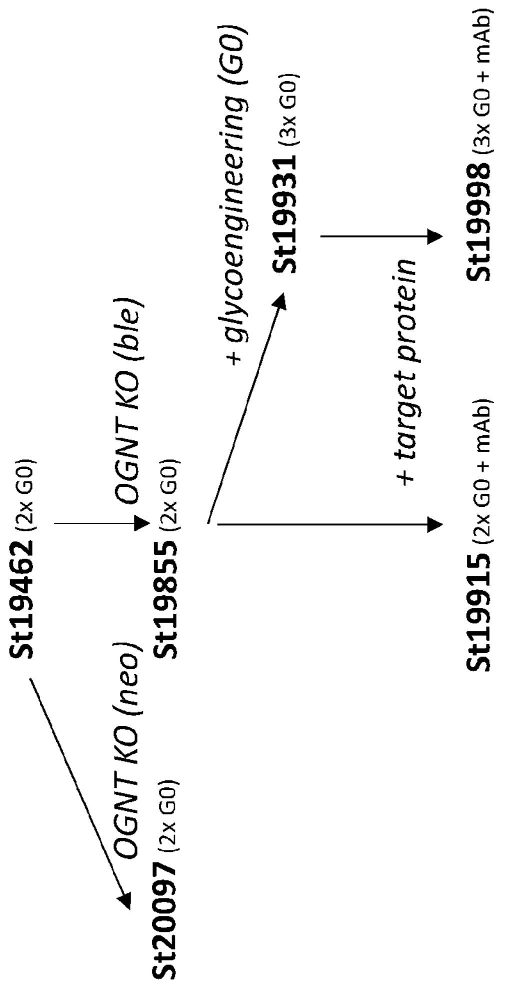
Figure 12B:
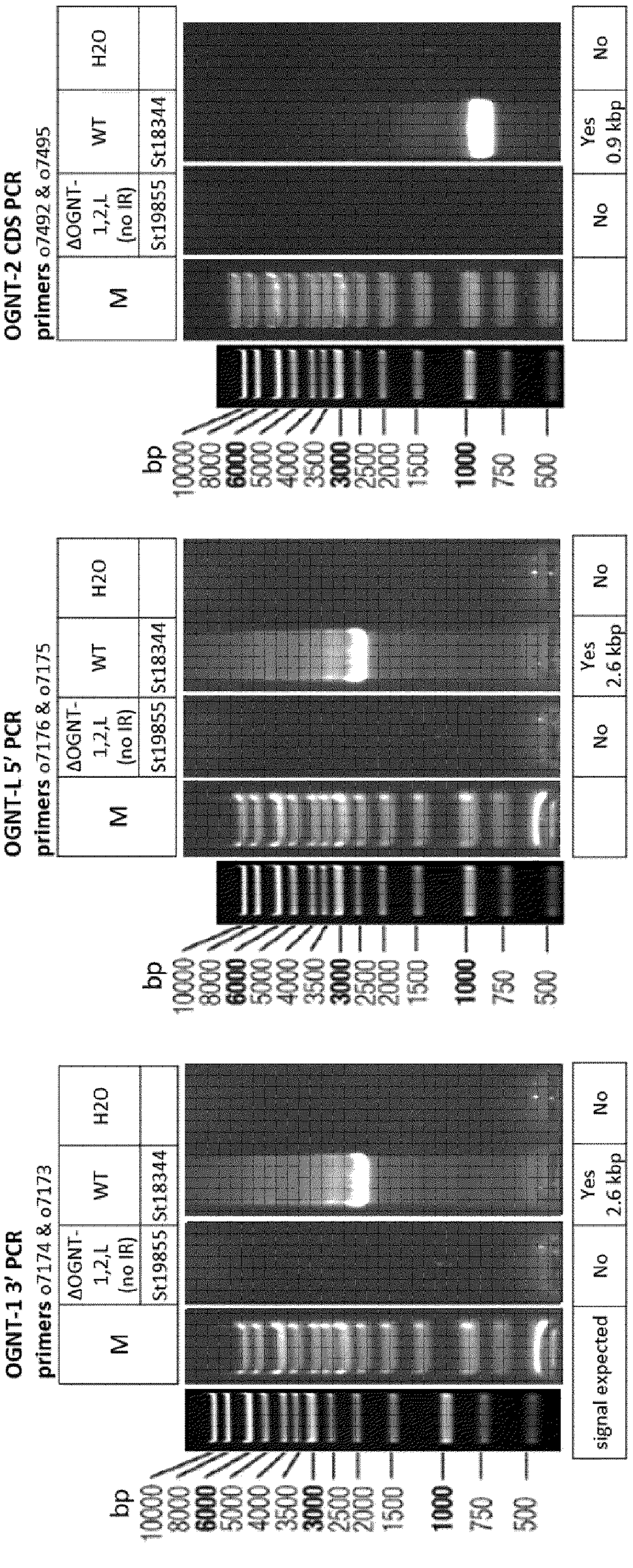

The example shown here demonstrates the triple OGNT knock-out in strain St19462, which already contains two expression constructs encoding the following glycosyltransferases: drMGAT1 (2×), drMGAT2, mnMGAT1, rnMGAT2 (3×), hsMGAT1, hsMGAT2 and sfGntI. The resulting strain St19855 thus is capable of N-glycan modification to G0, while natural O-glycosylation should be abolished (FIG. 12A). The absence of the OGNT genes was proven by PCR analysis probing for the open reading frames of OGNT-1, OGNT-2 and OGNT-L in the resulting cell line St19855 in comparison with a WT strain (St18344) (FIG. 12B).

Figure 12C:
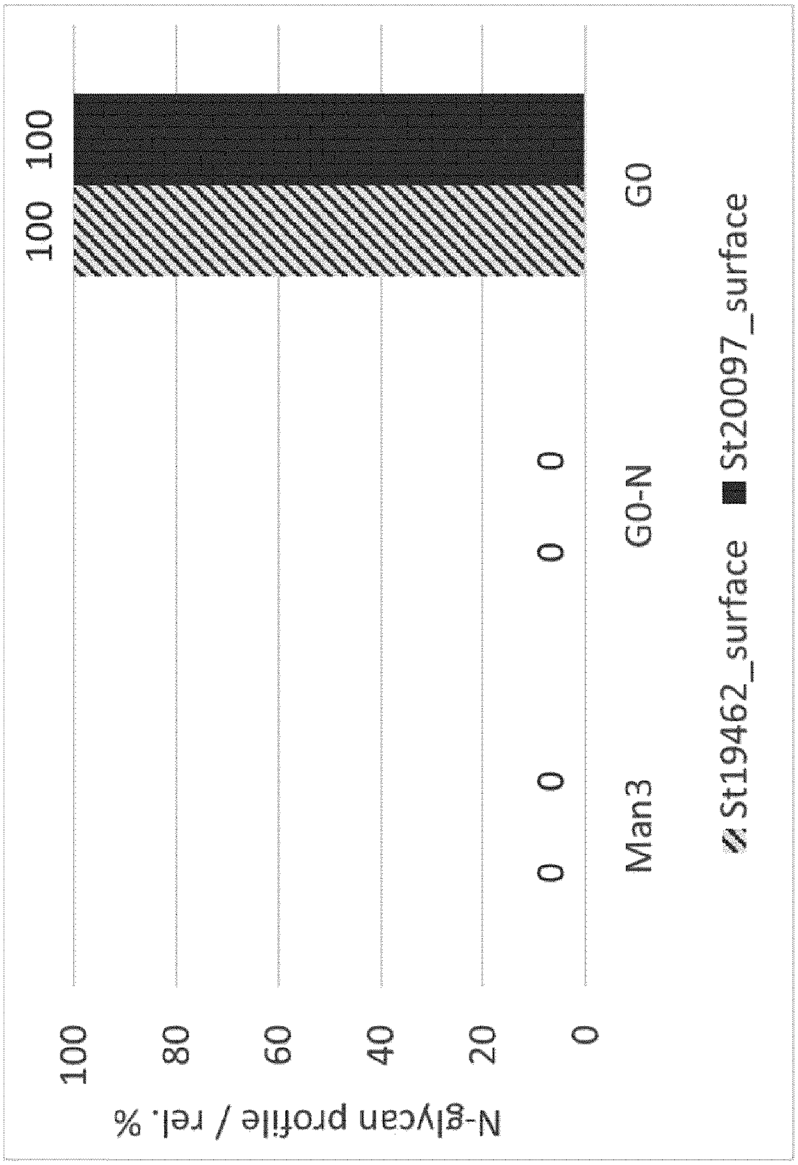
Figure 12D:
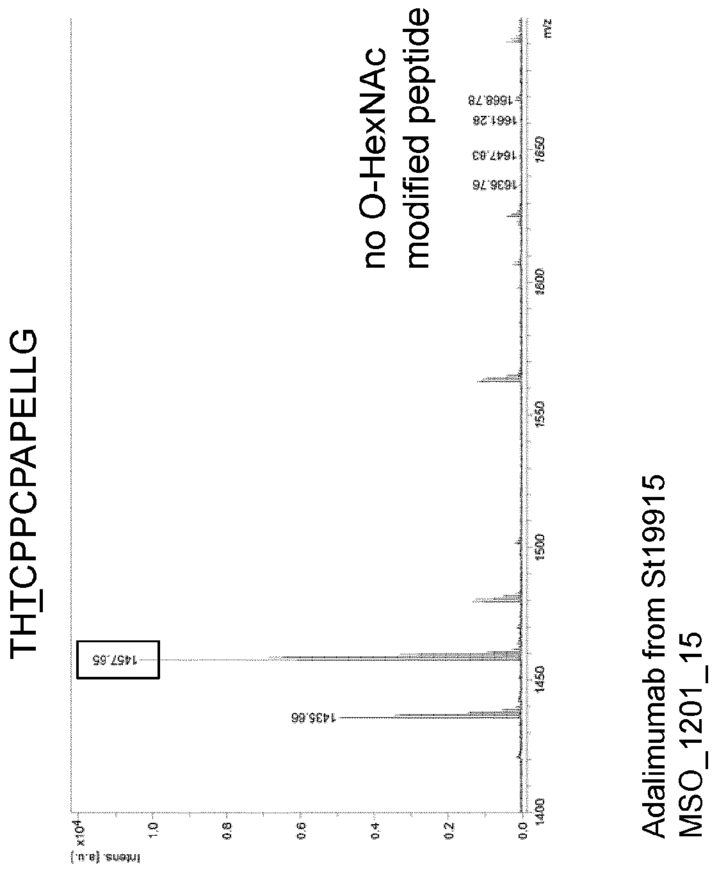

Analogously, cell line St20097 was created by RNP mediated replacement of all three OGNTs with the selection marker for Geneticin resistance. Comparison of the N-glycan profiles released from *L. tarentolae* surface proteins of the parental cell line St19462 and the triple OGNT knock-out cell line St20097 demonstrated that the efficiency of N-glycan conversion to G0 was not affected by OGNT knock-outs introduced by the RNP transfection method (FIG. 12C). This confirmed reproducibility of the approach.

Next, an Adalimumab expression construct was transfected into the knock-out cell line St19855 (FIG. 12A). The antibodies purified from the resulting cell line (St19915) were subjected to the FabRICATOR/GingisKHAN double digest described above. The MALDI spectrum shown in FIG. 12D confirmed the absence of O-HexNAc modification on the 14 aa peptide.

Figure 12E:
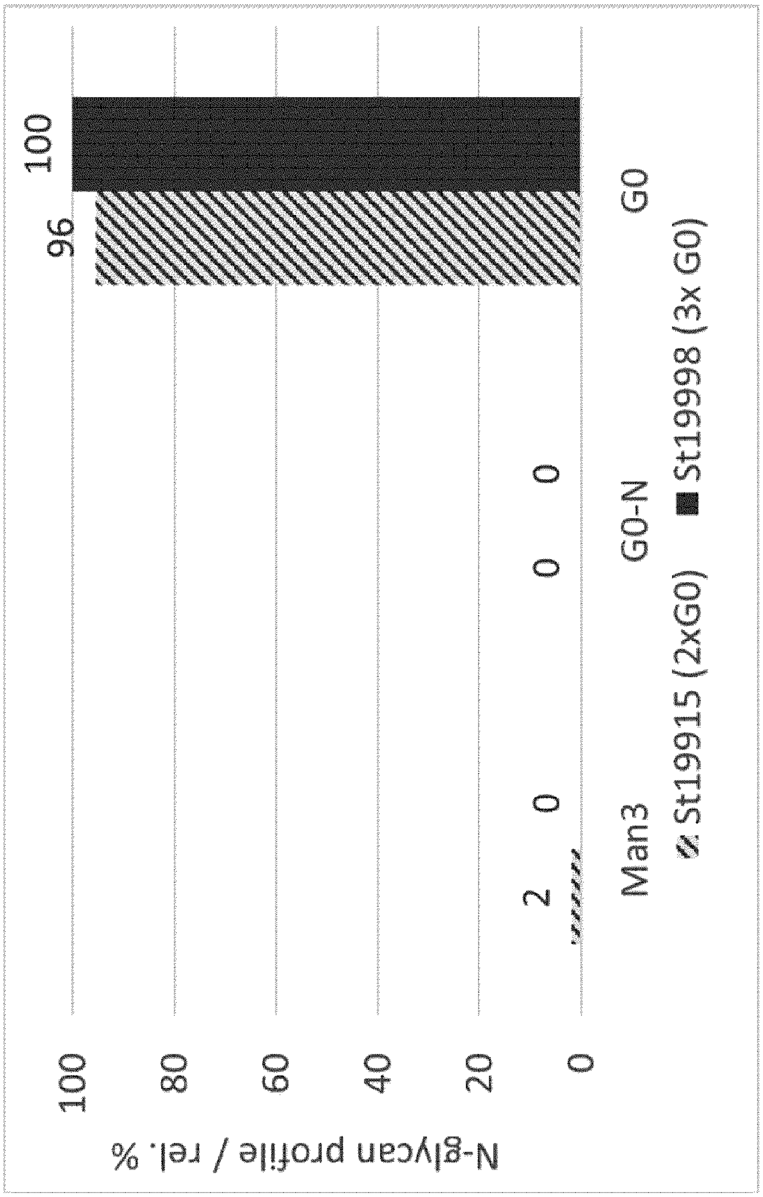

To assess how far a cell line that has undergone OGNT triple KO by RNP transfection can be further modified, the knock-out cell line St19855 was further modified by transfection of another glycoengineering module containing several copies of MGAT1 (drMGAT1, gjMGAT1, agMGAT1) and another copy of MGAT2. In order to analyze the resulting cell line St19931 (FIG. 12A) for its proficiency in glycoengineering, it was furthermore transfected with an Adalimumab expression construct, resulting in cell line St19998. Comparison of the N-glycan profiles released from antibodies (Fc) produced in cell lines St19915 and St19998 clearly demonstrated that further improvement of the entry strain St19855 was obtained by transfection of the additional glycoengineering module, since St19998 exhibits 100% conversion to G0, while in St19915 only 96% of the N-glycans are fully converted (FIG. 12E). This confirmed, that after undergoing CRISPR/Cas9 mediated OGNT removal by RNP transfection, the resulting cell lines were still fully modifiable. Moreover, these OGNT deleted and O-glycosylation deficient strains fully retained growth and target protein expression performance.

In order to assess whether the RNP transfection can be used to establish O-glycosylation free cell lines with alternative N-glycan phenotypes, the following cell lines were produced in addition to the previously shown G0 variants: A) St19955 (triple OGNT replacement with selection marker conferring resistance to Zeocin in WT *L. tarentolae* St18344) and St20107 (triple OGNT replacement with selection marker conferring resistance to Geneticin in WT *L. tarentolae* St18344), which homogeneously produce Man3

N-glycans and B) St19885 (transfection of galactosyltransferase expression cassette into a G0 N-glycan producing strain, in which all 3 OGNTs were replaced by the Zeocin resistance marker, St19855) and St20201 (transfection of galactosyltransferase expression cassette into a G0 N-glycan producing strain, in which all 3 OGNTs were replaced by the Geneticin resistance marker, St20097), which exhibit homogenous conversion of their surface N-glycans to G2. Table 11 summarizes the resulting strains and their characteristics. This further corroborated reproducibility of the RNP mediated OGNT removal procedure as well as the fact that this method can be utilized at any point of the cell line engineering process and does not interfere with other modifications. Importantly, O-glycosylation deficient and N-glycoengineered cell lines retained full capabilities for growth, viability and further target protein expression.

TABLE 11

Summary of triple OGNT knock-out cell lines with different N-glycan profiles and differen t resistance genes replacing the O-HexNAc transferase genes.

| Strain | OGNT triple KO (resistance) | N-glycan profile | PCR confirmation |
|---|---|---|---|
| St19955 | Ble (Zeocin) | n.a. (parental, St18344 = 100% Man3) | yes |
| St20107 | Neo (Geneticin) | n.a. (parental, St18344 = 100% Man3) | yes |
| St19855 | Ble (Zeocin) | n.a. (parental, St19462 = 100% G0) | yes |
| St20097 | Neo (Geneticin) | 100% G0 | yes |
| St19885 | Ble (Zeocin) | 95% G2, 4% G1-N, 1% Man3 | Parental (St19855) |
| St20201 | Neo (Geneticin) | 99% G2, 1% G1-N | Parental (St20097) |

In conclusion, the RNP mediated knock-out procedure in combination with introduction of an antibiotic resistance marker is as efficient as the one using constitutively expressed Cas9. Since it however requires only the expression of a single selection marker, additionally saves time by avoiding a second transfection step and finally also avoids retention of the Cas9 expression construct, this method is therefore preferred. As the method was proven to be highly effective in removing the three OGNT genes at once, it could also provide a useful tool for the knock-out of other targets.

7. EQUIVALENTS

The viruses, nucleic acids, methods, host cells, and compositions disclosed herein are not to be limited in scope by the specific embodiments described herein. Indeed, various modifications of the viruses, nucleic acids, methods, host cells, and compositions in addition to those described will become apparent to those skilled in the art from the foregoing description and accompanying figures. Such modifications are intended to fall within the scope of the appended claims.

Various publications, patents and patent applications are cited herein, the disclosures of which are incorporated by reference in their entireties.

Lengthy table referenced here

US12692472-20260728-T00001

Please refer to the end of the specification for access instructions.

LENGTHY TABLES

The patent contains a lengthy table section. A copy of the table is available in electronic form from the USPTO web site (https://seqdata.uspto.gov/docdetail?docId=US12692472B2). An electronic copy of the table will also be available from the USPTO upon request and payment of the fee set forth in 37 CFR 1.19(b)(3).

SEQUENCE LISTING (239 sequences)

SEQ ID NO: 1 - DNA, 9217 bp, Artificial Sequence
  pLMTB4123
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctaagcttatgcggctcaacgtcaagaaggcgctcatcttcgtcggctgcgtggtcttcctctgggtcctgctctcgtacgcgagcgtgattgaggtgccgcgcgcggtcccgcagaaggacccggccgtggagatcgagaagaaaatcattaagctgcaaaagcaggtggacgcccagatggccgagagcaaatcgctgctggcgaaggtcaagaagctgaagaagattagcgagggcgagaacgtgggtggcgaagaggacagcctgaaggactcggaggtgatgcagcacctgtcgcagccgatcctgccggtcctcgtcatcgcgtgtgaccgggtgaccgtccagcgctgcctggacaacctcgtcaagttccgccccagcaaggagacgttcccgatcattgtgagccaagactgtggccacaacgccacctacgaagtgatcacgagctacacggcgagcgacccgacgatcagcgtggtgcgccaaccggacctcagcgagatcgtgctgccccgcgtgaaggtgaagttccggggctactacaagatcgcccgccactataagttcgcgctgaaccacgtctttgagacgctgggccatgaagcggtgatcattgtggaggatgacctggacatctcgccggacttcttcgagtactttctcggcacgtacccgctgctgctgaaggatccgagcctgtggtgcatctcggcgtggaacgacaacggcaagatggaggtcattgatatgtcgcgccccgacctcctccatcgcacggacttcttcccgggcctcggttgggtcctccggcgcgaaatgtggcgcaagctggcgccgaagtggcccacggccttcttcgacgactggctgcgcaacccggtgaatatcgacggcaaggcctgcatccgcccggagatcagccgcacgtacagcttcggcaaggtcggcgtgagcaagggcctgttctttgacctccatctgcgcaacatccagctcaacatggagtacgtggagttcacgaagctgaacctgacgtacctcctgaaggagcactacgacgacgcgctggtgagcacggtgtacaacctgccggaaatgtcggcgagcgaggtggtggcgggcagcgacctgagcgccgacccggtgcgcgtcatgtactcgaacgcgaagacctaccagcgcgccgccaagaagctcggcctgatggacgatttccgctcgggcgtgccgcgcacggcgtatcgcggcattgtgacgtgctttatccggggccgccgcgtgtatctcgccccgagcttcgagtggaacaagtacgatcccacgtggggtgcgggcgcctggagccatccgcagttcgagtgatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 2 - DNA, 8001 bp, Artificial Sequence
  pLMTB4239
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctgccatggcctcgaggctcgtccgtgtgctggccgccgccatgctggttgcagcggccgtgtcggtcgacgcggcgccgccacgcctgatctgcgacagccgcgtgctggagcgctacctgctggaggcgaaggaagcggagaacatcaccaccggctgcgcggagcactgcagcctgaacgagaacatcacggtgccggacacgaaggtgaacttctacgcgtggaagcgcatggaggtcggccagcaggcggtggaggtctggcagggcctggcgctgctgagcgaggcggtgctgcgcggccaggccctgctggtgaacagcagccagccgtgggagccgctgcagctgcacgtggacaaggccgtgagcggcctgcgcagcctgaccaccctgctgcgcgccctgggcgcccagaaggaagcgatcagcccgccggacgccgccagcgccgccccgctgcgcacgatcacggccgacacgttccgcaagctgttccgcgtgtacagcaacttcctgcgcggcaagctgaagctgtacaccggcgaggcctgccgcaccggcgacgcgggagcgtggtcccacccgcagttcgagaagtaatctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatcctagtatgaagatttcggtgatccctgagcaggtggcggaaacattggatgctgagaaccatttcattgttcgtgaagtgttcgatgtgcacctatccgaccaaggctttgaactatctaccagaagtgtgagcccctaccggaaggattacatctcggatgatgactctgatgaagactctgcttgctatggcgcattcatcgaccaagagcttgtcgggaagattgaactcaactcaacatggaacgatctagcctctatcgaacacattgttgtgtcgcacacgcaccgaggcaaaggagtcgcgcacagtctcatcgaatttgcgaaaaagtgggcactaagcagacagctccttggcatacgattagagacacaaacgaacaatgtacctgcctgcaatttgtacgcaaaatgtggctttactctcggcggcattgacctgttcacgtataaaactagacctcaagtctcgaacgaaacagcgatgtactggtactggttctcgggagcacaggatgacgcctaactagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 3 - DNA, 10333 bp, Artificial Sequence
  pLMTB5026
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattggagatcggtacttcgcgaatgcgtcgagatggtaccaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctgccatgatcgcgggcagcgtgcgccgcggcgtgatcctgctgctggtggcggtggcggtggcgacgatggcggcggcggtgagcgcggcgcagatcgtgctgagccagagcccggcgatcctgagcgcgagcccgggcgagaaggtgacgatgacgtgccgcgcgagcagcagcgtgagctacatccactggttccagcagaagccgggcagcagcccgaagccgtggatctacgcgacgagcaacctggcgagcggcgtgccggtgcgcttcagcggcagcggcagcggcacgagctacagcctgacgatcagccgcgtggaggcggaggacgcggcgacgtactactgccagcagtggacgagcaacccgccgacgttcggcggcggcacgaagctggagatcaagcgcacggtggcggcgccgagcgtgttcatcttcccgccgagcgacgagcagctgaagagcggcacggcgagcgtggtgtgcctgctgaacaacttctacccgcgcgaggcgaaggtgcagtggaaggtggacaacgcgctgcagagcggcaacagccaggagagcgtgacggagcaggacagcaaggacagcacgtacagcctgagcagcacgctgacgctgagcaaggcggactacgagaagcacaaggtgtacgcgtgcgaggtgacgcaccagggcctgagcagcccggtgacgaagagcttcaaccgcggcgagtgctgatcgagggaggaggaggaggcgcgtagcattgcgtgcgggttatgtgtgcgtgcgtgtgtgtgtgcggtgcgcgcctttcctcttttttttctccctctcgtcggttttttttttctgaggagacggggcgaagacgcgagcggggggcggcgtttgtgtgtgtgtgtgcgcgtgtcgggggcagcggtgttggcggaacggccaacgccctgccccctccccgccctgcgacgtttctgcgcacccgttctctccttcctgcgtgcgtgtctgcgcgcatgcacatctgtccgcgtgtgccgcagcgctggtatttttgtgagggcagagccctgcctccccgcctctctgccgttggcaggtgaagcgaaaacgaagcgagagggcagtctgcatgtgtgtgcgagggcatgcggagcccccctccccccgccccctgccgtgctgcaccgctattgtggcgtcttctctcgttgtgcgcaagtgtggctgcaccacggccgcctcatgtgcgtgtgtgcgcatgtacacacacacacacacacacacacacacacgggcaggcgcacgctcctctctcttcagggagcgccgccccgctggtgtcattggacgagcatccgccgcgcatctcttcacccctcacccctcatccctctcccctctccccgcacacacacgcagtccttcgctttcactcttcgaacaaacacctcaaccatcttatcacctttctctcttccttgtcaaccatgcgtgaggccatgatcgcgggcagcgtgcgccgcggcgtgatcctgctgctggtggcggtggcggtggcgacgatggcggcggcggtgagcgcggcgcaggtgcagctgcagcagccgggcgcggagctggtgaagccgggcgcgagcgtgaagatgagctgcaaggcgagcggctacacgttcacgagctacaacatgcactgggtgaagcagacgccgggccgcggcctggagtggatcggcgcgatctacccgggcaacggcgacacgagctacaaccagaagttcaagggcaaggcgacgctgacggcggacaagagcagcagcacggcgtacatgcagctgagcagcctgacgagcgaggacagcgcggtgtactactgcgcgcgcagcacgtactacggcggcgactggtacttcaacgtgtggggcgcgggcacgacggtgacggtgagcgcggcgagcacgaagggcccgagcgtgttcccgctggcgccgagcagcaagagcacgagcggcggcacggcggcgctgggctgcctggtgaaggactacttcccggagccggtgacggtgagctggaacagcggcgcgctgacgagcggcgtgcacacgttcccggcggtgctgcagagcagcggcctgtacagcctgagcagcgtggtgacggtgccgagcagcagcctgggcacgcagacgtacatctgcaacgtgaaccacaagccgagcaacacgaaggtggacaagaaggcggagccgaagagctgcgacaagacgcacacgtgcccgccgtgcccggcgccggagctgctgggcggcccgagcgtgttcctgttcccgccgaagccgaaggacacgctgatgatcagccgcacgccggaggtgacgtgcgtggtggtggacgtgagccacgaggacccggaggtgaagttcaactggtacgtggacggcgtggaggtgcacaacgcgaagacgaagccgcgcgaggagcagtacaacagcacgtaccgcgtggtgagcgtgctgacggtgctgcaccaggactggctgaacggcaaggagtacaagtgcaaggtgagcaacaaggcgctgccggcgccgatcgagaagacgatcagcaaggcgaagggccagccgcgcgagccgcaggtgtacacgctgccgccgagccgcgacgagctgacgaagaaccaggtgagcctgacgtgcctggtgaagggcttctacccgagcgacatcgcggtggagtgggagagcaacggccagccggagaacaactacaagacgacgccgccggtgctggacagcgacggcagcttcttcctgtacagcaagctgacggtggacaagagccgctggcagcagggcaacgtgttcagctgcagcgtgatgcacgaggcgctgcacaaccactacacgcagaagagcctgagcctgagcccgggcaagtgacctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatcctagtatgaagatttcggtgatccctgagcaggtggcggaaacattggatgctgagaaccatttcattgttcgtgaagtgttcgatgtgcacctatccgaccaaggctttgaactatctaccagaagtgtgagcccctaccggaaggattacatctcggatgatgactctgatgaagactctgcttgctatggcgcattcatcgaccaagagcttgtcgggaagattgaactcaactcaacatggaacgatctagcctctatcgaacacattgttgtgtcgcacacgcaccgaggcaaaggagtcgcgcacagtctcatcgaatttgcgaaaaagtgggcactaagcagacagctccttggcatacgattagagacacaaacgaacaatgtacctgcctgcaatttgtacgcaaaatgtggctttactctcggcggcattgacctgttcacgtataaaactagacctcaagtctcgaacgaaacagcgatgtactggtactggttctcgggagcacaggatgacgcctaactagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttggtaccatcggatgccgggaccgacgagtgcagaggcgtgcaagcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 4 - DNA, 9255 bp, Artificial Sequence
  pLMTB5932
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgaagccagaaatgctagaccatggccagatgccaagcttactcaagcggcctctgcgcatgccgcggcgtcgcctcagcgcacgtcggcgacaggcgcttaaagtcttcatcgttattctgtgcttgtgtgcgtttcttttcatttttttcttctcagcgcggctgcccggcattctgcacgagcgcattactccaagtgaaaagccgtggctcacccgagcagggaactcgacgctcttcgagaaagtggttcacaaccgaatcccggggaccgcgtggcgcgatgctcacctgaacaccattatctccctcgcgaagtctggtgacgtggtgcacttgactcccactaaacacgttcgccaccgccgagccagcggcagcaactctagcacattccagaagtgggaatcactctatagaccgagcgacaggtaccatatccctgcctgggccacgccggaagaccgtgacacgctgcagcacgcgtctatctttacctccttagcttctttccgcgaccacgagtgtgcgctgacgctgcgcaaccttttcgacatggctgttgctccgcaccgcctgtacgttggtgtgagcgaggagcgcaacctgtctgacgagagctgtctctcgagcattggagtagaagacctggcaagcggtgagacgcggcgtgtgctctacggtgcagaagcgccagacacacttggcgtggaggtgcgctcgctgacgtgggcagctgtggctggatcacggcagttgctggacgtggatcaagagccgagagtgttcaccggcagtgctgccgaatctggcgcgcaacctacgggggtgtttgtacacccgtcgcacgcaatggagagggtgacgtgcattgccggggagctggaaacaacgcgtgacaggttgctcttagcggaggatgacgcgaaggaatccacagatggcaggtctgtgttccgacgcgggcgcgggggcccccagcaacagccgtcgcacgcactggctgggtgccgcgtgacgacgcgcgtgacgtaccccacgtccgcgcgcgggccgacatttggccggtacatcacaagcctgttcttttttgaccaggactactacatggtggtggacagccacacgcggttctctgtggactgggacatgaagctgatcacacgcgtgtttcagctgccgacgcggggcgtgctgtcgcactacccgaacggttaccgagaggggcatgaccgtgaggaattcgacaagacgagcgttatgctgatgtgcaccgcacaggtgctcagtaatgggatgccaaaacttggggcgcggtgggccaacgtatcgccacgcccggtcctgcagggctttgctgccgcgggcttcatgtttggggatgcgcagttcatgctggacacgccgttcgaccctttcctgccgtacattttcgacggcgaggaggtgctgtactctgcgcggatgtggacggccggctgggacctctacgggccggggcagccggacgtgtttcaccactacgggcgaatgcatacaccaaagtactttgaggtcctaacgccaactaaggctgcgcggcgtgagttgtcagagaagcgggcactgcaccttctgcggcgtgcgcacccgtggatcgaggagcttgtacgccgcggctatgtgagctctgacgggcagtcgactttgaagcctttgccgccggaggaggcgccggagacgcgactcatcgtgacagatgaagtggccgccgatacgcaggagatccgggtgtgggcgacatactacgggatgggcacggaacggcctgtggcagcttactggaagcacacggagctgtccgatgagttcgtgaaggcgaaggacgacgagcagaggtggatgggtggtactgggctgtgtgaaaaaagtgacgtcctggcggcaggtgcttacccgtacgacgtgccggactacgcgtacccgtacgacgtgccggactacgcgtacccgtacgacgtgccggactacgcgtgagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 5 - DNA, 10659 bp, Artificial Sequence
  pLMTB5933
attattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctgccatgggtatggtgcgcagtggtgtcttcgacccccccccccccccccgcccccaacagccaagcgttgtgctccgccgccgccgtggcacttggcgtctacggagtcgattccgtgtaggcgcggactcacccacccgccaacacctgcgcatgctgcttcacttatctctgctgttcgatgcgacatcctccgcaccctcctccacgcggacgacacacacacacacacacacacacacacacacacacggactttctgtgacttcattgcacacaggcgctcgcgccaccgcagttgggagggctcctcgcacgcgcgacgctctcatggacactcacgtgaccgcctgtgtaaagcgggtgccctcaccggcgccgttccgtgatggcctcgacgctgtcgcgacagccggcgccgcagtcgtcggtgacgcagcgctgtgcatggatgccgaagtggggtctggactcgatgaacgtgggcgtggccctgctggtttcacgccggcttccgtggcgttcgccaaggagggtaatggtagacttgctagtctcgctcaaccgtcgcacagcagcaactaccgaggcccatccaccgtggcgctgaggacagcggcgatgggccatgacgatgcgcggacgcacgtgacccacacgacccccgcgttatcgtcatcggcaacagtgcacagccgcggcagtgtgcgaccgctgaaacattggatgtgttgtgccagccgcgttcatcacgtgctgcgctcgttgggcattctaaacgacgacgccgatccggcgaacatgtcgcggatactcgcgtgctcgtgcgccactattggcgcgttactcgtgcttctcataatcagcttcgctgcactggtggtgctactggtcgttgtggtgcctgacgcccagcatcgactttctcggacggtctccccactgctggacttgaacagtaaaaggaacgaccgcgcagccgggggcggccgcggcggtgatgataccgcgtctggcctctcagtattcgacctccagattcgacgtctgctagccagtgagggtctcgaagggttcttgcgtaaggcccaccgcgcggcagatctgcgtcggcgtgtccaacgcaacgcgacgctcttggcggcactgcgcagggcgaatgcgacccgcggcaagggtgcgggggacgacgtggactgggcaagtcttgcgcagacgctcccggagctggagcatctctctttcctgctagcggaggtgtgcgctcatgttcgggcggtgcaagaacacgacccggtgatggggcttgtgaagctgagcgatttcttgctcaacgtgaaaggtcggaaggcggcgctggagaaggctgcagagcgtgcgcgcagcctggcggccaatgcgacgtcgccggctgctgctgcatcagacattggggatgctgtggcgaggtggaatgcggcgctgaaggagtcgcttgcggggcgctcagaggccgctcgcctgcgtgcgcagctgcgcggcttcattggcgtctctccttgggagacggagcggctgacagagcagccctttgacgacctcgcgctgctgcagtaccgacacgcgtgggcgcagtcggaggtgctgccgatcctgcgcggccggctgggtcgtgctggcgcgcgagccgccgaggaggacccaaacgccgcggtgctgcgcaacaacgccgtccgccatccaccacagaacaggtctgcacatgcacgctcagcgcggttaagtccgcaagaggtcgcagaacgcatagcgatgaaggcagacctgtacgaggtcgcgtccatcttcaaccacgtctactactacccgctgcgtcgctacagtgctctccgcccctacggcggaagctcggttgccgacaccgacgcgtggtacaccgccatcaccgcggtcgtgcagactcgtttcggcgtcccaattacctcgaacgcagcgcagaccaccgagactgcagcagcggctctgccgctgctgcagcgcgactctcccctctccaccctcgcactgcagcggctggggctggagcgcgcagaagaagtggcgcgcctgcacgctgaagatcgccctcttatgccgcaggcactgcactcggacgccgcggaaagtacgcacagcatctttgtgagtctggcgagctaccgtgacatggagtgtgcgccgacgctgatgagtctgttccgtacagcgcgcaatcctcaccgcttgtacgtcggagttgctcagcagaaccgtgctggcgacgcgccgtgtctcgtgccagagatgtacaccccttacctgtgcccgtccgaaggtgtgccggactccccacgtgaacggggcgcacgcgcgcgcacgttgtacggcgaaggcgtggacttcatgaagagcgccaacgtgcctgaagcccgtagctttgatgggggtgtctgcttcctggcggagcaggtgcgcctacgtgagattgacgcaagacaggcgaaggggccgacatatggccgctacatggcgatgctgctgtaccgtggcgagaccctggcgctggtgttggactcacataaccgatttcgccccatgtgggacgtcctgagcgccacgatgctgatgcgcatggaggacccgaaggcggtgctgtcgcactacccagagagctaccagggcgagcaggtcgacttgcagccgtaccgcacgaccacatcgtacctctgccgggcaaatttcttgaacaactttggttaccttcgactcgaggctatcgtgatcgagtccgcatcggatttcgcgaagaacaacgtctataacgacccgtacgtgcgcgttcagtcgacggacatcgatccagccacgaaccatcgactgccgcagccgtgggtggcggggggattcttagtctcctttggccgcatcttccgcgacgtcccctttgacccgcacctgccgtacgtcttcgatggggaggaggtgctctactcgatgcggctctggacgcacggctacaacatctactcccccgcgcgaggcgcctgcttccatatatacactcgctcatccgcgccaaaggtgtgggccgagtcgcctcagtggtacagcatgcaggcccgcgtgcacgagcggattcagttcttggtgcaggcgcacctcctcaacaaggaagacgtgatggtaccggcgaacagcacgagctctttcgtcataatggactcgagccgctacgggatgggcaagcagcgcaccgtcgcgcagtggtacgactacgccggcgtagacccggtgaggtacaccctggatgggcgctggtgtggcaagagcaagcgcgatgcaggtgcttacccgtacgacgtgccggactacgcgtacccgtacgacgtgccggactacgcgtacccgtacgacgtgccggactacgcgtagcttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaat

SEQ ID NO: 6 - DNA, 10350 bp, Artificial Sequence
  pLMTB5934
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatggacggtgacgcgaactcgcagaggggcgcggaaaccaacggtgctgatctgcaccttccaggaatggcgctgctgcgtggtcggcacggcaacgggggcccgaccggtgatcacctctccgccacttgggttctcgaggacccggaaacgattaggaccgagcaggagatgtacgtggagcgctacctagcccccacgcaggccgacgtggagctcacgccgctgcgcgtgatctcgtcgtactacaacacgcagggaagccgcagcctccaccgcatggctgccgagacagagaaggcgatgaacgatgacggctacgcgacatacattcaacgttcgtcgaccttttacgacgtctcgcacgcggctcgtcgtggatacggccaggagggcagcattttcgtagccgtgcccttcacgctcacagacatcacgccacaaatggtgggcatcatccgtcgccgggcgtcagccgtgccgacgtcgtcgaagacccagaagccaacctcgtcgaactcgccgttgaaggaaagggacaacagcgtcaccgacgacggctttcatgagctgcgactcaccgcggcacgctgcgctatgacggtggagtcccttttccgccaagcccaccgtggcgttgcggtgacggtcggcacgcttgatgtggtcaccgcgagcgggatctcctcggcggtggacctcgatttctcaaagccatccgacgtgctgttcccgctgaaaccggaagaccgcgccagcctgggcgcgcgcaggcggcgctacacccgcatcacttgcgagcccccagactttgccagtggctgggacgacgccagctacggatttcgctggaaagacaacctgcgccgccgccgcgtggtggtgcccttgacacagctagagggcttatccgctactccaacggatccgctacgcggtgaggacgcagccgcgacactggagaggcgctttcccctgcaatatatggggcgctacgccaccctgcagctctaccggggtgagtcgtacgtattctttctgcgcaccggcgctctggttctcccaaactgggacctgatgcttcggctgctgtacttgcgcacccctgcgcgggatcgcgcggtgctcagtagccgcccgacaccgcgcgtggcatggatcgcactggcggcctctgtcgcaaagatgtgggacacggaaccgttcctgcggctgtcgttgacagcatcgtggcatcgcaacggcaagggcgcgaccgaccgcgacggggaaggtgcggccaccgcgccaccgcccgaccaggtaggccagcgtcttttggccgcgctacccgcggatgtggcatcgtggctgagcgcggcgcgggaggaggcggagcttgtgctatggctggtgacgccgagctggctgtggcccaccatggcagagacgctggcagattggcgccagctcaccgcttcttcagacgcacagccgccaccaggggccacggcctctacactgcgcctgctgttcgccagcgatgccgtgaacggcgttctcggcgatgcagcgtcgactctgatgacggctgacttggacactgtccagacgactcctgtaaagcgctccgatgccgcggcagcgtccctgcatgggcaacgcgtcgtgagcctgcgcggtggcaccaaccctacgacgaacagcacgccacaggcggtcgtggctgccagcctcacaccctctgaggtatacgagcttcttttcttggctgagaagcggccgccaacgccagagcagccgatcgttcaggtgccgtcatcagaaccaacgttacaccgagtaccgtcccaggatttgggcccgtcggtcgagccactctgcggggaggcgacgtccgaggcaccgtattactctgctgctgataaggcgctgctgaagcgctccttcgagtactgctggttaaaggagcaccggaaagtcttgcggcagcagctgcaccgcctcctgcactccaccaaggcaacaacagtgctgaagacgacccaggccacgaaggtgcccgctgcaggtgcgcggggtgcgaagggcggcagagaggggggccctgtggtggcggaggtggcgcctcgctcgagtgtgtgcttggcggacatgcgctaccttgcgccgatggaggcgacgttgctcacgggcgccgacgaaggcacgtcggacagtggtccgagtgcgcaccatgaggagcacgcagccgatcagccctcgctgcgacaagagaatgcctggcttacgtccgccgcgaacgtgggcaaggtgcatggtgtggcgacctcgcttgtctccaaagccgctcgtggcaccaaggagcgacaaggggggtcgccgcagtcacccaaggatgctgcgtccaccccccctgagccgacgccgtacgtgctccagtcagcggcatcgctggatctgctttttggtcctgcagaggccttctttgagttcgatacggcgcaccggctgcgcactcgagcgcgcagtctctcggagcagcttgaagagcgccgcctccgtcgtgaaggtctaaccgcgacggccgcgcacgctcaggtgcccgaggctgtcgaactggatacctctctgcagttcatggatggcgatctggaggatgtctacgtgacacaggcgctctggacgcgggggtggaacatttttgggaccacggagccggtggccgtaggcactggcgaggaggagttctcccgctccgcgtcggcggcgacgaccgcaccgacatcttcttccgtggccgaggatagcgtgccagccgagctgcgtgatgcgcgcaccttcacacacgacaagttctgggctttgctgatggcccaccgcgatgcgggtacgccgcttggcgccaccgagacaaggcagcaggcctctgcgccgcgggagagctcgctgttgctctaccccttacgccgaactatgaaggagtgggagctgttcgctggcatgccgctgacaaccctccgtgatgcgctgcacccgaccgcaggtgcttacccgtacgacgtgccggactacgcgtacccgtacgacgtgccggactacgcgtacccgtacgacgtgccggactacgcgtgagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 7 - DNA, 3863 bp, Artificial Sequence
  pLMTB6459
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatcctgcaggtgaaatggtgtatcccatgacacgtcttacgtcatgttcctccctccttcgtatgcgtacgactctcctccgcctccgcctccgcctccgcctccgcctccgcctccgccttctctgcgccggtttcctggaggatggagagctcttgctcatagattgaagaaagaccaggcaagccacggaaaactccgaacaaaagcggactcacgcggccgtctgcatttgacgtgcttgcatacatatacgcaccaaccttgtgcacgtcttgttgacatccgtaacacttgcctcattttttccgtgctgctcggatgcacactcctggtgtggggcgtagtcactattcgtctctcaccaacacacacacacacacacacacacacctgtacatctctctctctctccttttctgtgtgccccggcggacgtgcgtgcgtgtctaatcactgaaattcttcacattgcatagaacgtagcgtcaggacgcagcctcgaacggcgaagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtggagcttttgtgtctgtcgtattgacaacaccgactgcaacaaggtgtagatagaagttggccttctcgctcgctcgcacgctcttcacgctcctgctttccttgctgtgccttgccaccacctaggctcgagatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcttcgaaatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 8 - DNA, 3850 bp, Artificial Sequence
  pLMTB6460
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatcctgcaggtgaaatggtgtatcccatgacacgtcttacgtcatgttcctccctccttcgtatgcgtacgactctcctccgcctccgcctccgcctccgcctccgcctccgcctccgccttctctgcgccggtttcctggaggatggagagctcttgctcatagattgaagaaagaccaggcaagccacggaaaactccgaacaaaagcggactcacgcggccgtctgcatttgacgtgcttgcatacatatacgcaccaaccttgtgcacgtcttgttgacatccgtaacacttgcctcattttttccgtgctgctcggatgcacactcctggtgtggggcgtagtcactattcgtctctcaccaacacacacacacacacacacacacacctgtacatctctctctctctccttttctgtgtgccccggcggacgtgcgtgcgtgtctaatcactgaaattcttcacattgcatagaacgtagcgtcaggacgcagcctcgaacggcgaagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtggagcttttgtgtctgtcgtattgacaacaccgactgcaacaaggtgtagatagaagttggccttctcgctcgctcgcacgctcttcacgctcctgctttccttgctgtgccttgccaccacctagggctcgagagtatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtttcgaaatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 9 - DNA, 4061 bp, Artificial Sequence
  pLMTB6463
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatcctgcaggaccgcaccgacatcttcttccgtggccgaggatagcgtgccagccgagctgcgtgatgcgcgcaccttcacacacgacaagttctgggctttgctgatggcccaccgcgatgcgggtacgccgcttggcgccaccgagacaaggcagcaggcctctgcgccgcgggagagctcgctgttgctctaccccttacgccgaactatgaaggagtgggagctgttcgctggcatgccgctgacaaccctccgtgatgcgctgcacccgacctgacgcatgcagggatatcgtccccaacttgcgaggacctcctgcacaacgacctggatctcggcgcacgcgcaaccagcgcatgcgttgtgcatcagaaacatcgtacgccatcgatcgtctgctttctctggtaagcctggcgcatcggcgccgacgcatcatctggacctcctcctcggcgtcacacgcgaaggtgcatcaacgcgcccggtgcttcagctctcctgatgagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaggcttttgtgtctgtcgtattgacaacaccgactgcaacaaggtgtagatagaagttggccttctcgctcgctcgcacgctcttcacgctcctgctttccttgctgtgccttgccaccacctaggcttcagctcgagagtatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggttgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggattcgaaatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 10 - DNA, 4061 bp, Artificial Sequence
  pLMTB6466
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatcctgcaggcggtgggcgcgcgcgtaatcgggcacgcgtcaggcagcgccacagaggcctgcccagacagcgaacgggtccatcgtacaccctcggtccccggcattcgcaggactgtgggccatgcggtcacgacttcttccgagtcggcggcctcgcgccgcccgctgggcccgctgcaccgttttctgtctgggctttttcattggcgctattactctctgcggcgtcgttgcgtggaggatcatgagtgacatgagcgaggacgtgaagggccgcagaacgctgacgcagcacccttccccaggcaagccagggtgccacgggtgactgacgctggcgctgacgacgacgctgggttgttgcgcagcagtggaggggcagctccatacacggaaggcttagaggagctggtcctgctgctccgtatctacgccgaagaaactggtgtccgggtaaccgacacgtcttatgcgcttccagagggcgtgtctgcaggtgcaggcctcagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaggcttttgtgtctgtcgtattgacaacaccgactgcaacaaggtgtagatagaagttggccttctcgctcgctcgcacgctcttcacgctcctgctttccttgctgtgccttgccaccacctaggcttcagctcgagagtatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggttgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggattcgaaatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 11 - DNA, 3861 bp, Artificial Sequence
  pLMTB6467
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatcctgcaggcggtgggcgcgcgcgtaatcgggcacgcgtcaggcagcgccacagaggcctgcccagacagcgaacgggtccatcgtacaccctcggtccccggcattcgcaggactgtgggccatgcggtcacgacttcttccgagtcggcggcctcgcgccgcccgctgggcccgctgcaccgttttctgtctgggctttttcattggcgctattactctctgcggcgtcgttgcgtggaggatcatgagtgacatgagcgaggacgtgaagggccgcagaacgctgacgcagcacccttccccaggcaagccagggtgccacgggtgactgacgctggcgctgacgacgacgctgggttgttgcgcagcagtggaggggcagctccatacacggaaggcttagaggagctggtcctgctgctccgtatctacgccgaagaaactggtgtccgggtaaccgacacgtcttatgcgcttccagagggcgtgtctgcaggtgcaggcctcagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaggcttttgtgtctgtcgtattgacaacaccgactgcaacaaggtgtagatagaagttggccttctcgctcgctcgcacgctcttcacgctcctgctttccttgctgtgccttgccaccacctaggctcgagatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcttcgaaatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 12 - DNA, 4057 bp, Artificial Sequence
  pLMTB6470
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatttaattaaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccatggcctaaggctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaggtgtgctttccaggccgctgagcggagaggtgcggagggcagtccaggaaggtggggagggaggagggatggttcccaagcgagaaggggacggacgagctcaaggctgaaagtttcagccaacggtttccggcgctgcatccgttctcatgttttggcactcgtcatatgcttttatttctgtaatcgtttttggaggagggaggaggggaggagatgtgggcgagcagagacggcggcagcagcaaaaaaaagggggggcgcccaccggcgctggtgaggcgtgcagggggaagagggtggcatgcgacatgcacaaccaaacgtgcgcgtgtgcagatgtgctggcgtgcgtcgtgagtgtgtgatttatttttgaatgacaccttatcattgctctctctgcctcacactctctcgcttccaccgctttaccttgctacgagtgtcgcttcggtataccgtcactgacgttgcctctcccctctccatactttcgcctgcaggatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 13 - DNA, 4088 bp, Artificial Sequence
  pLMTB6471
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatttaattaatgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaacctcggagatccatggcctaaggctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaggtgtgctttccaggccgctgagcggagaggtgcggagggcagtccaggaaggtggggagggaggagggatggttcccaagcgagaaggggacggacgagctcaaggctgaaagtttcagccaacggtttccggcgctgcatccgttctcatgttttggcactcgtcatatgcttttatttctgtaatcgtttttggaggagggaggaggggaggagatgtgggcgagcagagacggcggcagcagcaaaaaaaagggggggcgcccaccggcgctggtgaggcgtgcagggggaagagggtggcatgcgacatgcacaaccaaacgtgcgcgtgtgcagatgtgctggcgtgcgtcgtgagtgtgtgatttatttttgaatgacaccttatcattgctctctctgcctcacactctctcgcttccaccgctttaccttgctacgagtgtcgcttcggtataccgtcactgacgttgcctctcccctctccatactttcgcctgcaggatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 14 - DNA, 4381 bp, Artificial Sequence
  pLMTB6474
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatttaattaagaggcagcgcggctatcgtggctggccacgacgggcgttccttgcgcagctgtgctcgacgttgtcactgaagcgggaagggactggttgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacgcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgacctcggagatccatgggaagtcctaaggctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaagggctacaacatctactcccccgcgcgaggcgcctgcttccatatatacactcgctcatccgcgccaaaggtgtgggccgagtcgcctcagtggtacagcatgcaggcccgcgtgcacgagcggattcagttcttggtgcaggcgcacctcctcaacaaggaagacgtgatggtagcggcgaacagcacgagctctttcgtcataatggactcgtgccgctacgggatgggcaagcagcgcaccgtcgcgcagtggtacgactacgccggcgtagacccggtgaggtacaccctggatgggcgctggtgtggcaagagcaagcgcgattagagggagaatgatgatgtgaccgaggtggcgcgctcgcacgtgtcctcctcctccccctcctcctcctcttcttcttcctccccttggccgccctctgcggtggtcctctctcaccttttcatgtgttcctgtgtggcgtgcgtgtcgctcaggggagttcccgtgtgtgtcctgcaggatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 15 - DNA, 4058 bp, Artificial Sequence
  pLMTB6475
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatttaattaaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccatggcctaaggctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaagggctacaacatctactcccccgcgcgaggcgcctgcttccatatatacactcgctcatccgcgccaaaggtgtgggccgagtcgcctcagtggtacagcatgcaggcccgcgtgcacgagcggattcagttcttggtgcaggcgcacctcctcaacaaggaagacgtgatggtagcggcgaacagcacgagctctttcgtcataatggactcgtgccgctacgggatgggcaagcagcgcaccgtcgcgcagtggtacgactacgccggcgtagacccggtgaggtacaccctggatgggcgctggtgtggcaagagcaagcgcgattagagggagaatgatgatgtgaccgaggtggcgcgctcgcacgtgtcctcctcctccccctcctcctcctcttcttcttcctccccttggccgccctctgcggtggtcctctctcaccttttcatgtgttcctgtgtggcgtgcgtgtcgctcaggggagttcccgtgtgtgtcctgcaggatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 16 - DNA, 4058 bp, Artificial Sequence
  pLMTB6478
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatttaattaaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccatggcctaaggctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaagtgaaggagtgggagctgttcgctggcatgccgctgacaaccctccgtgatgcgctgcacccgacctgacgcatgcagggatatcgtccccaacttgcgaggacctcctgcacaacgacctggatctcggcgcacgcgcaaccagcgcatgcgttgtgcatcagaaacatcgtacgccatcgatcgtctgctttctctggtaagcctggcgcatcggcgccgacgcatcatctggacctcctcctcggcgtcacacgcgaaggtgcatcaacgcgcccggtgcttcagctctcctgatgtatggtgcgcagtggtgtcttcgacccccccccccccccccgcccccaacagccaagcgttgtgctccgccgccgccgtggcacttggcgtctacggagtcgattccgtgtaggcgcggactcacccacccgccaacacctgcgcatgctgcttcacttatctctgctgttcgatgcgacatcctccgcaccctcctccacccctgcaggatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 17 - DNA, 4273 bp, Artificial Sequence
  pLMTB6807
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtacccacacgggcaggcgcacgctcctctctcttcagggagcgccgccccgctggtgtcattggacgagcatccgccgcgcatctcttcacccctcacccctcatccctctcccctctccccgcacacacacgcagtccttcgctttcactcttcgaacaaacacctcaaccatcttatcacctttctctcttccttgtcaaccatgcggttccggatctataagcggaaggtcctgatcctgaccctggtcgtcgccgcctgcggcttcgtcctgtggtcctccaacggccggcagcggaagaacgacgccctggccccccccctgctggactccgagcccctgcggggcgccggccacttcgccgcctccgtcggcatccggcgggtctccaacgactccgccgcccccctggtccccgccgtcccccggcccgaggtcgacaacctgaccctgcggtatcggtccctggtctatcagctgaacttcgaccagatgctgcggaacgtcgacaaggacggcacctggtcccccggcgagctggtcctggtcgtccaggtccacaaccggcccgagtatctgcggctgctgatcgactccctgcggaaggcccagggcatccgggaggtcctggtcatcttctcccacgacttctggtccgccgagatcaactccctgatctcctccgtcgacttctgccccgtcctgcaggtcttcttccccttctccatccagctgtatccctccgagttccccggctccgacccccgggactgcccccgggacctgaagaagaacgccgccctgaagctgggctgcatcaacgccgagtatcccgactccttcggccactatcgggaggccaagttctcccagaccaagcaccactggtggtggaagctgcacttcgtctgggagcgggtcaaggtcctgcaggactataccggcctgatcctgttcctggaggaggaccactatctggcccccgacttctatcacgtcttcaagaagatgtggaagctgaagcagcaggagtgccccggctgcgacgtcctgtccctgggcacctataccaccatccggtccttctatggcatcgccgacaaggtcgacgtcaagacctggaagtccaccgagcacaacatgggcctggccctgacccgggacgcctatcagaagctgatcgagtgcaccgacaccttctgcacctatgacgactataactgggactggaccctgcagtatctgaccctggcctgcctgcccaaggtctggaaggtcctggtcccccaggccccccggatcttccacgccggcgactgcggcatgcaccacaagaagacctgccggccctccacccagtccgcccagatcgagtccctgctgaacaacaacaagcagtatctgttccccgagaccctggtcatcggcgagaagttccccatggccgccatctcccccccccggaagaacggcggctggggcgacatccgggaccacgagctgtgcaagtcctatcggcggctgcaggcgggagcgtatccttatgacgtccctgattacgcatatccttatgacgtccctgattacgcatatccttatgacgtccctgattacgcataaggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 18 - DNA, 4320 bp, Artificial Sequence
  pLMTB6811
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtaccgctccggccccttccgggtccagtattcctcccgggactccttcaaggtcctggcccggaacctgggcgtcatggacgacctgaagtccggcgtcccccgggccggctatcggggcgtcgtctccttcatctcccggggccggcggatctatctggccccccccgagggctggaccaagtatgacgtctcctggtcctaagagacaaacgtggcggatgtgatgttttcagtttacttcgcctcttttcgttttcctttcaggcgacttcccttttgagttttcgtgtatgcaattgttgctgttctactgtgcagttgtcaccagcgccgcttttgggcttgtggcgtcggtgattctgcctacgtgattcttctccacgttaaccacacgtgttattgcccttcgcttttgcgtgcgcggtctgggcagccactaggtataggggtgtggtggagtgcacccgtgacggtgacatcccttcgacccgcgtctgctgcctcagacgttcgtggagagctgacatgtcgacatccctttggtgtgagcatttgtgagcgtgtgggtgtttagtgtttttgttaccggttttgttgcgcttgtgtgctctagtagtgtttgtgcgcgtgcgtggggcactatgaagcaagctgcggtagatgcgctgcgtggggtggtaggctgcaggactacaaccattaagattcctctctctctccttggctcgctctacattgaccctctgcggtggtctgcttctctacaatcgatatgcccgacacctcccgttgtgtgttcgttctcctttatcactaggccattgcattcggccctgttgatgtggctacggtcttagacacgcacaaatggtttgcattatttatcggccatggtgtgtgtcacactcgcttgattgattttgttctgatgtgcagcatgaaatgtcgggagaataaaacatagtgccttcatcataggatgacggatgcttgaatccgtctttgtcttctgaacaactctctgcagagggcgcgggtggctgacttctctcccccttcgtatggcgaaaggatggctttggcgtccttccgggcttcgcgcgcataggggagcagaatatgtgctgcaaagaagacgcctggcggctgcgtgcgtgcgtacgtgtgagtgtgtgtgtgtgtgagggctacgctgccggcaccactactcgtgcctatcttcaccaccttctcgttctcctccgtcttctcttttgcctggtgagcatttgtgttcaccatacctcaacgcgcttcgcatagctgcccaacctcctactactctgtttggctaatctcagctcgttagtttctctcgttaatcataacgagtttgcccctcccccccattgtgtgtgtgtgtcttgtaaaaaaaaaaaaaaaacattatcttctacctttccgcgcctcacatccgcatctttcgtgtgctgcccactcaccatcaccggcctccttcgttggcagagcaacatttgttcatgagcagctctccgtactgtgtgtgtgcccactagccggtgcagagtaggagccgcgcttttgttgttgtacgtatcttttgacgtgggtgtgcgtgcaagcaaggatctacgcgcaacaagtagcaggcaagcggatctgttcgccggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 19 - DNA, 4320 bp, Artificial Sequence
  pLMTB6815
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtacccaaagacataccagcgtgccgcgaagaagctcggtctgatggacgactttcgatcaggtgttccccgcacggcgtaccgtgggatagtaacatgcttcattcgcggccgccgggtgtaccttgcccccagtttcgagtggaacaagtacgacccgacttggggcgcgggtgcctggtcgcatccccaatttgagaagtaggagacaaacgtggcggatgtgatgttttcagtttacttcgcctcttttcgttttcctttcaggcgacttcccttttgagttttcgtgtatgcaattgttgctgttctactgtgcagttgtcaccagcgccgcttttgggcttgtggcgtcggtgattctgcctacgtgattcttctccacgttaaccacacgtgttattgcccttcgcttttgcgtgcgcggtctgggcagccactaggtataggggtgtggtggagtgcacccgtgacggtgacatcccttcgacccgcgtctgctgcctcagacgttcgtggagagctgacatgtcgacatccctttggtgtgagcatttgtgagcgtgtgggtgtttagtgtttttgttaccggttttgttgcgcttgtgtgctctagtagtgtttgtgcgcgtgcgtggggcactatgaagcaagctgcggtagatgcgctgcgtggggtggtaggctgcaggactacaaccattaagattcctctctctctccttggctcgctctacattgaccctctgcggtggtctgcttctctacaatcgatatgcccgacacctcccgttgtgtgttcgttctcctttatcactaggccattgcattcggccctgttgatgtggctacggtcttagacacgcacaaatggtttgcattatttatcggccatggtgtgtgtcacactcgcttgattgattttgttctgatgtgcagcatgaaatgtcgggagaataaaacatagtgccttcatcataggatgacggatgcttgaatccgtctttgtcttctgaacaactctctgcagagggcgcgggtggctgacttctctcccccttcgtatggcgaaaggatggctttggcgtccttccgggcttcgcgcgcataggggagcagaatatgtgctgcaaagaagacgcctggcggctgcgtgcgtgcgtacgtgtgagtgtgtgtgtgtgtgagggctacgctgccggcaccactactcgtgcctatcttcaccaccttctcgttctcctccgtcttctcttttgcctggtgagcatttgtgttcaccatacctcaacgcgcttcgcatagctgcccaacctcctactactctgtttggctaatctcagctcgttagtttctctcgttaatcataacgagtttgcccctcccccccattgtgtgtgtgtgtcttgtaaaaaaaaaaaaaaaacattatcttctacctttccgcgcctcacatccgcatctttcgtgtgctgcccactcaccatcaccggcctccttcgttggcagagcaacatttgttcatgagcagctctccgtactgtgtgtgtgcccactagccggtgcagagtaggagccgcgcttttgttgttgtacgtatcttttgacgtgggtgtgcgtgcaagcaaggatctacgcgcaacaagtagcaggcaagcggatctgttcgccggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 20 - DNA, 4273 bp, Artificial Sequence
  pLMTB6819
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtaccgctgcccactcaccatcaccggcctccttcgttggcagagcaacatttgttcatgagcagctctccgtactgtgtgtgtgcccactagccggtgcagagtaggagccgcgcttttgttgttgtacgtatcttttgacgtgggtgtgcgtgcaagcaaggatctacgcgcaacaagtagcaggcaagcggatctgttcgccatgcggttccggatctataagcggaaggtcctgatcctgaccctggtcgtcgccgcctgcggcttcgtcctgtggtcctccaacggccggcagcggaagaacgacgccctggccccccccctgctggactccgagcccctgcggggcgccggccacttcgccgcctccgtcggcatccggcgggtctccaacgactccgccgcccccctggtccccgccgtcccccggcccgaggtcgacaacctgaccctgcggtatcggtccctggtctatcagctgaacttcgaccagatgctgcggaacgtcgacaaggacggcacctggtcccccggcgagctggtcctggtcgtccaggtccacaaccggcccgagtatctgcggctgctgatcgactccctgcggaaggcccagggcatccgggaggtcctggtcatcttctcccacgacttctggtccgccgagatcaactccctgatctcctccgtcgacttctgccccgtcctgcaggtcttcttccccttctccatccagctgtatccctccgagttccccggctccgacccccgggactgcccccgggacctgaagaagaacgccgccctgaagctgggctgcatcaacgccgagtatcccgactccttcggccactatcgggaggccaagttctcccagaccaagcaccactggtggtggaagctgcacttcgtctgggagcgggtcaaggtcctgcaggactataccggcctgatcctgttcctggaggaggaccactatctggcccccgacttctatcacgtcttcaagaagatgtggaagctgaagcagcaggagtgccccggctgcgacgtcctgtccctgggcacctataccaccatccggtccttctatggcatcgccgacaaggtcgacgtcaagacctggaagtccaccgagcacaacatgggcctggccctgacccgggacgcctatcagaagctgatcgagtgcaccgacaccttctgcacctatgacgactataactgggactggaccctgcagtatctgaccctggcctgcctgcccaaggtctggaaggtcctggtcccccaggccccccggatcttccacgccggcgactgcggcatgcaccacaagaagacctgccggccctccacccagtccgcccagatcgagtccctgctgaacaacaacaagcagtatctgttccccgagaccctggtcatcggcgagaagttccccatggccgccatctcccccccccggaagaacggcggctggggcgacatccgggaccacgagctgtgcaagtcctatcggcggctgcaggcgggagcgtatccttatgacgtccctgattacgcatatccttatgacgtccctgattacgcatatccttatgacgtccctgattacgcataaggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 21 - DNA, 4995 bp, Artificial Sequence
  pLMTB6848
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtacctcatcggcgagaagttccccatggccgccatctcccccccccggaagaacggcggctggggcgacatccgggaccacgagctgtgcaagtcctatcggcggctgcaggcgggagcgtatccttatgacgtccctgattacgcatatccttatgacgtccctgattacgcatatccttatgacgtccctgattacgcataaggagactgagctttagcgagggaacccgcatggcatacgttgccataacaagtgaccatctactctccttaaagtcatgggggtgctgctgcttggccggtgctgatcactcttgttgaggttccttcaggtgcggggactctctttggcgccttccctgcttgccgtgctctctcgacttgttctaattcccacgtgtgctctcttccgctttcgttgtagtggtgtacgctgcggttgagcttgttgtgcttgcgctacatttctcttcgaaggcggaggcaggcgcgcctgcgcagtgccgtgacgagagccactgccgtgtcgagctgcgagcaagagcagttaaggcaaaagggtaggtgagaaagatgactctgtgcggtgctctcttgtccatgcctgtccgttgttgtctcccctgtctctcccttttttcggcttgagtgacgttttgctgcctttgtacgttgttgtagtgtccttactgctctcgattgccgtcacgttgatgcccctatgtgtctccttttcttgcctcgcacattgcggatgtgctcccttctccgcccccttttttttttttttgccacagccggtgctgccttgttgcgagagcatgcgcatttggaacaaatggcacatagtcgtagcatctgcgctctggcctcggcgcctctctacacctttgctcaccgtgcatcacgccatctacaccatgttctcttcgtgttctgccactcttttaaatgctttgccttcccttggaatcccatgctcagccctcccctgcttctcacggtgcctgtggctctcggctgcgctctcctgtcgcctgttcttcttcttccgtccctgtggatgctgccgatttcccgtctgcccccgtctttcgtttgccgcctcccccttctgtgacgaatgccgtctctgtatcccggacgctccctcacgccaacccactcctcttttgcgttcttgcgtgtgcgtcgggcttctctccctccccctccccctccccctcccctgcctaccccatcaccgatgggtgtgtgggagagaggtggcaggggaagagggagtgcagataatgtgagacagaattgaaatatctgctctccgacacacagggagtaaatgcattcaacagggatggtaaggacacgcactggcgtgacatggagaaaaaataatggagtaatgcatgcagggctgaactcggcacagaggtacgcacccgtgggcaccctcttctctacggccctacctctttgtctccaatcgttttgtccccgtatgtcattattattgctcacctcgcggcattcttgatgtagccgcctcttgacatgtatagtgttgttcattagtatccaccgcaagaaaagaaatcctgcataccaccaatcgcgcgcactggacgttgccgaaagcagtcagtgggcaccttggacgttgccgccggtgtggaagtggccgcgtcgcaagcaggcctccatgacgttgactgcacgtccctcccggaaaggggatggctttggtgccatttaggacacaaatggagcttcttgtcgacccttgcttcgaggaatgaggctgcgtgtatgtgtcttggtgacccctttgggctgtgcagcttgtggcgtgtgcgcaccggcgtgtgccaacgcccaggtactgtgcgcacgttcgtatctccatacgctagctgaccgagacgcatgccctccgccaccctcagtggcgcgcaccttctctcgtttgagctctttatgctctcgtgaatggcacacaacatcccgtgactatcacgatgatccttctcaagccacaccgcttgccttttctacagctctgcgttctctggcccatcctcctcttgtttgctttccctctttgcacatccgtgtgcgcgtccttgttcttctcttctgcgcacactattctgcgcccgcgacccgcgcttcgactgctgtcgggtcatgccttgtgctgcgcgttcagctcttcattgcccctcggccttgtacatagcggctctccgtcatcgacgttttcctctctcttcagctctatacactccctcccttgtcaacacactacactgtgtctccccctttcatctctcctcccctgtcacaggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 22 - DNA, 4429 bp, Artificial Sequence
  pLMTB6852
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtacctattctgcgcccgcgacccgcgcttcgactgctgtcgggtcatgccttgtgctgcgcgttcagctcttcattgcccctcggccttgtacatagcggctctccgtcatcgacgttttcctctctcttcagctctatacactccctcccttgtcaacacactacactgtgtctccccctttcatctctcctcccctgtcacaatggtccggaagaagggctccctgatcctgtgcggcgccttcctgttcgtcgcctggaacgccctgctgctgctgttcctgtggggccggccccccatcggccggctgggcgagggcggcggcgccgagcccggcgccggcgaggagtggggcgccggcaagtccaaggtcggcggcgccaacggcctggccggcgaggtcatccggctggccgaggaggtcgagtccgagctggagacccagaagaagctgctgaagcagatccagtcccaccgggagctgtgggagcagcggaaggagctggagaagcgggagtccgaggacaccaaggacgagaagatcgacgtcgagcccaagaagccccggcagatccccgccgtccacctgtcccacaaggtcgtcgaggacgcccagaccgtcaccaagaagatgcagaccctgatggtcacccccccccagctggtcatgaaggagcaggagaccgaccagaagaacaagcagatgatggaggaccagctgggcctgaccaccccctccccccagatcatcatccccatcctggtcatcgcctgcgaccgggtcaccgtcaagcggtccctggaccggctgatccagtatcggccctccgccgagctgtatcccatcatcgtctcccaggactgcggccacgccgacaccgcccgggtcatcggctcctatggctcccagatcacccacatctcccagcccgacctggccgacatccccgtccggcccgaccaccggaagttccagggctattataagatcgcccggcactatcggtgggccctgaaccaggtcttcaacgtcttcgcctattccaccgtcgtcatcgtcgaggacgacctggaggtcgcccccgacttcttcgagtatttccgggccctgtatcccatcctgcggtccgaccccaccctgtggtgcatctccgcctggaacgacaacggccgggacggcctggtcgaccccggcaaggccgagctgctgtatcggaccgacttcttccccggcctgggctggatgctgctgaaggaggtctgggccgagctggagcccaagtggcccaaggccttctgggacgactggatgcggcaccccgagcagcggaagaaccggtcctgcatccggcccgaaatttctcggaccatcaccttcggccggaagggcgtctccctgggccagttcttcgaccagtatctgcggtatatcaagctgaacaccgagttcgtccccttcaccaagcacgacctgtcctatctggtccgggagaagtatgacgtctccttcgagaaggacgtctattccgcccccctggtcaaggtcgaggagctgcagcacggcggctccctgaagggctccggccccttccgggtccagtattcctcccgggactccttcaaggtcctggcccggaacctgggcgtcatggacgacctgaagtccggcgtcccccgggccggctatcggggcgtcgtctccttcatctcccggggccggcggatctatctggccccccccgagggctggaccaagtatgacgtctcctggtcctaaggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 23 - DNA, 4451 bp, Artificial Sequence
  pLMTB6855
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtaccagcaagcaggcgctgtggggtttatccacacagaagagaaaatagggtccgtgaagcctgcctacaaagggcgtggaatgataaacacgacgtacaagaacatgccgagcagggcaccaacaaatgggacgataaggggtaaccaaaagtagtggtcgtgcaacgtgaagggctctgagccccagagcatcgcggagaggacgcgaggtgcaaagtcacgtgcgggattgaggcaataccctgagttaatgcctgtagtggcaccaataaccaccagcagcagcccaatagccaccggcttgtagtttgtagccggcgtcatgcggtcatctgtaatggcgagaatgcccatcagtagtgccatggtgttgaacacctcgctccacaccgcatagccggtcgccaccttcgggtaggtgacgaagatcccgccatacttggacgccatcgtctctgttggaagtaagttcctctcgccctcgtcaaagtgggacttgaacgcgtggggatggatcgcgagggacgcggggtttgagggccgtgggtggtgtggagagtgtggttgattattgtatggtggtgagggtggaaggtgtggcggggatggtggtgcggtggtgtcggaaggggtgtgtgagagggcgcgggtccttgagggagggtgggtgtgttgttgttttgcgggtgttatccggggcttgggtgttggtgtgattggtgactatgtaggggtgaagggtgagtggagggggtcgccagaggcgttccgttctacgaagcttcattcctatgtccgactccgaagcatgcctgcagttctgctggctatgtgggcgtgtctgggcaacgactgaattgagaaggggagtcgaaacggtgcgtggatgctgtgtttgtgctacacacaagcaaaggcaacaacacaagcgcatcgagccagacgaaccaacccaatattcacacaactgtacgtggccgcgcgctgtatctccgatgggatgatgcgtgtgcgtgtgccaccaccacgtactagtttccagccttactgcttgtataccttgtcttttgcgttgtgcttgcgcgtgctgtgtacctctgctcgtgcgttccgtatcccgggacctgcgggcggtgggtgccacacaacccgtcacattcaacatcactcatacatctcaccgatgtgtgcgtgtgcttgctgtgtgcgtgtgttgtgtggcgtcaaacctgtttgaaaacacacccctagcactattcgaccgcgaaagcgcccccccaaaggggccggtgtgcaatgcgagctacatgtatgtgtagagagcgctgcgccgaactagtcgtgcgtgctgaacatgttttgtgtgtgctgccgtgtctacacgtttgcagcggaaactcggttgaaccagaaacagaacttgattgttgctgcatttcgaggaatttcagccaaacaagaggtcaacaaccaagccgcgtgtacacatatacacacaccgcgtgtatgtatatatgcgtttgttttgttaccacaaatactgagttgtctgatgtgagcttctgctacagacgcaattcaggaaatacaacaaaatacaacacttgatcatcaatgcgcaatgtgcgcgtgttgtgtgtgtgtgtgcgagcgcacacacacatgcacacgactcacgttgtcacacaattgagagctctctcttctccttcccctctctctcctctctcctctctccagagctctctcttctccttcccctctctctcctctctcctctctccagagctcgagccaccggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 24 - DNA, 4075 bp, Artificial Sequence
  pLMTB6860
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtaccgctgcccactcaccatcaccggcctccttcgttggcagagcaacatttgttcatgagcagctctccgtactgtgtgtgtgcccactagccggtgcagagtaggagccgcgcttttgttgttgtacgtatcttttgacgtgggtgtgcgtgcaagcaaggatctacgcgcaacaagtagcaggcaagcggatctgttcgccatgcgcctgcgcgagccgctgctgagcggcagcgcggcgatgccgggcgcgagcctgcagcgcgcgtgccgcctgctggtggcggtgtgcgcgctgcacctgggcgtgacgctggtgtactacctggcgggccgcgacctgagccgcctgccgcagctggtgggcgtgagcacgccgctgcagggcggcagcaacagcgcggcggcgatcggccagagcagcggcgagctgcgcacgggcggcgcgcgcccgccgccgccgctgggcgcgagcagccagccgcgcccgggcggcgacagcagcccggtggtggacagcggcccgggcccggcgagcaacctgacgagcgtgccggtgccgcacacgacggcgctgagcctgccggcgtgcccggaggagagcccgctgctggtgggcccgatgctgatcgagttcaacatgccggtggacctggagctggtggcgaagcagaacccgaacgtgaagatgggtggtcgttacgcgccgcgcgactgcgtgagcccgcacaaggtggcgatcatcatcccgttccgcaaccgccaggagcacctgaagtactggctgtactacctgcacccggtgctgcagcgccagcagctggactacggcatctacgtgatcaaccaggcgggcgacacgatcttcaaccgcgcgaagctgctgaacgtgggcttccaggaggcgctgaaggactacgactacacgtgcttcgtgttcagcgacgtggacctgatcccgatgaacgaccacaacgcgtaccgctgcttcagccagccgcgccacatcagcgtggcgatggacaagttcggcttcagcctgccgtacgtgcagtacttcggcggcgtgagcgcgctgagcaagcagcagttcctgacgatcaacggcttcccgaacaactactggggctggggcggcgaggacgacgacatcttcaaccgcctggtgttccgcggcatgagcatcagccgcccgaacgcggtggtgggccgctgccgcatgatccgccacagccgcgacaagaagaacgagccgaacccgcagcgcttcgaccgcatcgcgcacacgaaggagacgatgctgagcgacggcctgaacagcctgacgtaccaggtgctggacgtgcagcgctacccgctgtacacgcagatcacggtggacatcggcacgccgagctggtcccacccgcagttcgagaagtaaggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 25 - DNA, 4391 bp, Artificial Sequence
  pLMTB6861
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtacccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagctagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaagcccgtaagtattggcggcaccaacaaaagctcccagaaactgagcgagaaaatagcctggtagcttcttccaagggaacccggcaaacacgcagtttgccagcgtcacagccgggttcaagtgaccaccggacacacccatggtcaggaaaaggctgatggtcagccccaaaccccagccaaagttgatagccaggtagctcgggttcgactggccggcgccagtggcaccagcgttgaacacagtggtcgccaccacgccggtgccgaaggcaatcaggaaaaacgttccaaagaactcgctgaagtactcgcgtaactgccatcggaactcgtagagaggccatttgctctgtgacatccagttccatttgctctccttctcctgcggatcttcctcattcatgtgaactccagtggccacctcgtccgggtcctctttttgctcatataactgagcctcgacatcgtattgcgagggagccgtacctttatgcgcgggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 26 - DNA, 4806 bp, Artificial Sequence
  pLMTB6906
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtacctccgccacagccgcgacaagaagaacgagccgaacccgcagcgcttcgaccgcatcgcgcacacgaaggagacgatgctgagcgacggcctgaacagcctgacgtaccaggtgctggacgtgcagcgctacccgctgtacacgcagatcacggtggacatcggcacgccgagctggtcccacccgcagttcgagaagtaacctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtccggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 27 - DNA, 4451 bp, Artificial Sequence; identical to SEQ ID NO: 23
  pLMTB6944

SEQ ID NO: 28 - DNA, 4219 bp, Artificial Sequence
  pLMTB6952
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtaccaacacttgatcatcaatgcgcaatgtgcgcgtgttgtgtgtgtgtgtgcgagcgcacacacacatgcacacgactcacgttgtcacacaattgagagctctctcttctccttcccctctctctcctctctcctctctccagagctctctcttctccttcccctctctctcctctctcctctctccagagctcgagccaccatgcgcttgaacgtaaagaaggcactcattttcgtcggctgcgttgtctttctgtgggtgctcctctcctacgcgagcgtcattgaagtgccgcgcgctgtgccacagaaggatcccgcagtagaaattgagaagaagatcataaagctgcagaagcaggtggatgcccagatggccgagtctaagagtctgcttgcgaaggtcaagaagcttaagaagatatcggagggagagaacgtgggtggcgaggaggactccctgaaagacagcgaagtgatgcagcacctgtcccagccgattctccctgtccttgtgatcgcgtgcgaccgtgtgacggtgcagcgatgcctggacaatctcgtgaagtttcgcccatccaaggagacctttccgatcattgtgtcgcaggactgcggccacaacgctacatacgaggtgataactagctacacggcttcagatccgacgatctcggtggtacgacaaccggacttgtccgagatcgtgctgccgcgggtgaaggtgaagttccgagggtactataagatcgcccgccactacaaatttgccttgaaccacgtttttgagacactgggtcacgaggctgtgatcatcgtagaggacgacctcgatatcagcccggacttcttcgaatactttttgggcacgtaccctttgcttctcaaggacccgagcctttggtgtatctctgcctggaacgacaatggtaagatggaggtgatcgatatgagccggccagatctgctccaccggacagatttcttccccggtcttgggtgggttttgcgccgggagatgtggcggaagcttgcacccaagtggcctacagctttttttgacgactggcttcggaacccagtgaacatcgacggcaaggcatgtattcgcccagagattagccgcacgtactcattcggaaaagtgggagtctcgaaagggctcttttttgaccttcatctccggaacattcagctcaatatggaatatgtggagtttacgaagcttaacctgacctacctcctgaaggagcactacgacgacgctctcgtgagtacggtgtacaatctgcccgagatgtcagcctcggaagttgtggcggggagtgatctcagcgcagaccccgtgcgagtcatgtactcgaacgcaaagacataccagcgtgccgcgaagaagctcggtctgatggacgactttcgatcaggtgttccccgcacggcgtaccgtgggatagtaacatgcttcattcgcggccgccgggtgtaccttgcccccagtttcgagtggaacaagtacgacccgacttggggcgcgggtgcctggtcgcatccccaatttgagaagtagggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 29 - DNA, 3606 bp, Artificial Sequence
  pLMTB6958
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtacccaaagacataccagcgtgccgcgaagaagctcggtctgatggacgactttcgatcaggtgttccccgcacggcgtaccgtgggatagtaacatgcttcattcgcggccgccgggtgtaccttgcccccagtttcgagtggaacaagtacgacccgacttggggcgcgggtgcctggtcgcatccccaatttgagaagtagtcgagggaggaggaggaggcgcgtagcattgcgtgcgggttatgtgtgcgtgcgtgtgtgtgtgcggtgcgcgcctttcctcttttttttctccctctcgtcggttttttttttctgaggagacggggcgaagacgcgagcggggggcggcgtttgtgtgtgtgtgtgcgcgtgtcgggggcagcggtgttggcggaacggccaacgccctgccccctccccgccctgcgacgtttctgcgcacccgttctctccttcctgcgtgcgtgtctgcgcgcatgcacatctgtccgcgtgtgccgcagcgctggtatttttgtgagggcagagccctgcctccccgcctctctgccgttggcaggtgaagcgaaaacgaagcgagagggcagtctgcatgtgtgtgcgagggcatgcggagcccccctccccccgccccctgccgtgctgcaccgctattgtggcgtcttctctcgttgtgcgcaagtgtggctgcaccacggccgcctcatgtgcgtgtgtgcgcatgtacacacacacacacacacacacacacacacgggcaggcgcacgctcctctctcttcagggagcgccgccccgctggtgtcattggacgagcatccgccgcgcatctcttcacccctcacccctcatccctctcccctctccccgcacacacacgcagtccttcgctttcactcttcgaacaaacacctcaaccatcttatcacctttctctcttccttgtcaaccggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 30 - DNA, 4391 bp, Artificial Sequence; identical to SEQ ID NO: 25
  pLMTB6961

SEQ ID NO: 31 - DNA, 11472 bp, Artificial Sequence
  pLMTB7100
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctaccatggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagcgcaccgcccgccgccgctacacccgccggaagaaccggatctgctatctgcaagagattttcagcaacgagatggccaaggtggacgacagcttcttccaccgcctggaagagtccttcctggtggaagaggataagaagcacgagcggcaccccatcttcggcaacatcgtggacgaggtggcctaccacgagaagtaccccaccatctaccacctgcgcaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgcccgcctgagcaagagccgccggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgcgcgtgaacaccgagatcaccaaggcccccctgagcgcctctatgatcaagcgctacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaaccgcgaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggcccgcggaaacagccgcttcgcctggatgacccgcaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgcgcaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggaccgcgagatgatcgaggaacggctgaaaacctatgcccacctgttcgacgacaaagtgatgaagcagctgaagcggcggcgctacaccggctggggccgcctgagccggaagctgatcaacggcatccgggacaagcagtccggcaagacaatcctggatttcctgaagtccgacggcttcgccaaccgcaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggcccgcgagaaccagaccacccagaagggacagaagaacagccgcgagcgcatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgacccgcagcgacaagaaccggggcaagagcgacaacgtgccctccgaagaggtcgtgaagaagatgaagaactactggcggcagctgctgaacgccaagctgattacccagcgcaagttcgacaatctgaccaaggccgagcgcggcggcctgagcgaactggataaggccggcttcatcaagcgccagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagcgcaacagcgataagctgatcgcccgcaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaacgcagcagcttcgagaagaatcccatcgactttctggaagccaagggctacaaagaagtgaaaaaggacctgatcatcaagctgcctaagtactccctgttcgagctggaaaacggccggaagcgcatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagcgcgtgatcctggccgacgctaatctggacaaagtgctgtccgcctacaacaagcaccgggataagcccatccgcgagcaggccgagaatatcatccacctgtttaccctgaccaatctgggagcccctgccgccttcaagtactttgacaccaccatcgaccggaagcgctacaccagcaccaaagaggtgctggacgccaccctgatccaccagagcatcaccggcctgtacgagacacggatcgacctgtctcagctgggaggcgacaaacgcccggcggccacgaaaaaggccggccaggcaaaaaagaaaaagtaagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 32 - DNA, 12118 bp, Artificial Sequence
  pLMTB7101
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctaccatggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagcgcaccgcccgccgccgctacacccgccggaagaaccggatctgctatctgcaagagattttcagcaacgagatggccaaggtggacgacagcttcttccaccgcctggaagagtccttcctggtggaagaggataagaagcacgagcggcaccccatcttcggcaacatcgtggacgaggtggcctaccacgagaagtaccccaccatctaccacctgcgcaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgcccgcctgagcaagagccgccggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgcgcgtgaacaccgagatcaccaaggcccccctgagcgcctctatgatcaagcgctacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaaccgcgaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggcccgcggaaacagccgcttcgcctggatgacccgcaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgcgcaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggaccgcgagatgatcgaggaacggctgaaaacctatgcccacctgttcgacgacaaagtgatgaagcagctgaagcggcggcgctacaccggctggggccgcctgagccggaagctgatcaacggcatccgggacaagcagtccggcaagacaatcctggatttcctgaagtccgacggcttcgccaaccgcaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggcccgcgagaaccagaccacccagaagggacagaagaacagccgcgagcgcatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgacccgcagcgacaagaaccggggcaagagcgacaacgtgccctccgaagaggtcgtgaagaagatgaagaactactggcggcagctgctgaacgccaagctgattacccagcgcaagttcgacaatctgaccaaggccgagcgcggcggcctgagcgaactggataaggccggcttcatcaagcgccagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagcgcaacagcgataagctgatcgcccgcaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaacgcagcagcttcgagaagaatcccatcgactttctggaagccaagggctacaaagaagtgaaaaaggacctgatcatcaagctgcctaagtactccctgttcgagctggaaaacggccggaagcgcatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagcgcgtgatcctggccgacgctaatctggacaaagtgctgtccgcctacaacaagcaccgggataagcccatccgcgagcaggccgagaatatcatccacctgtttaccctgaccaatctgggagcccctgccgccttcaagtactttgacaccaccatcgaccggaagcgctacaccagcaccaaagaggtgctggacgccaccctgatccaccagagcatcaccggcctgtacgagacacggatcgacctgtctcagctgggaggcgacaaacgcccggcggccacgaaaaaggccggccaggcaaaaaagaaaaagtaagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 33 - DNA, 11896 bp, Artificial Sequence
  pLMTB7102
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctaccatggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagcgcaccgcccgccgccgctacacccgccggaagaaccggatctgctatctgcaagagattttcagcaacgagatggccaaggtggacgacagcttcttccaccgcctggaagagtccttcctggtggaagaggataagaagcacgagcggcaccccatcttcggcaacatcgtggacgaggtggcctaccacgagaagtaccccaccatctaccacctgcgcaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgcccgcctgagcaagagccgccggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgcgcgtgaacaccgagatcaccaaggcccccctgagcgcctctatgatcaagcgctacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaaccgcgaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggcccgcggaaacagccgcttcgcctggatgacccgcaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgcgcaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggaccgcgagatgatcgaggaacggctgaaaacctatgcccacctgttcgacgacaaagtgatgaagcagctgaagcggcggcgctacaccggctggggccgcctgagccggaagctgatcaacggcatccgggacaagcagtccggcaagacaatcctggatttcctgaagtccgacggcttcgccaaccgcaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggcccgcgagaaccagaccacccagaagggacagaagaacagccgcgagcgcatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgacccgcagcgacaagaaccggggcaagagcgacaacgtgccctccgaagaggtcgtgaagaagatgaagaactactggcggcagctgctgaacgccaagctgattacccagcgcaagttcgacaatctgaccaaggccgagcgcggcggcctgagcgaactggataaggccggcttcatcaagcgccagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagcgcaacagcgataagctgatcgcccgcaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaacgcagcagcttcgagaagaatcccatcgactttctggaagccaagggctacaaagaagtgaaaaaggacctgatcatcaagctgcctaagtactccctgttcgagctggaaaacggccggaagcgcatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagcgcgtgatcctggccgacgctaatctggacaaagtgctgtccgcctacaacaagcaccgggataagcccatccgcgagcaggccgagaatatcatccacctgtttaccctgaccaatctgggagcccctgccgccttcaagtactttgacaccaccatcgaccggaagcgctacaccagcaccaaagaggtgctggacgccaccctgatccaccagagcatcaccggcctgtacgagacacggatcgacctgtctcagctgggaggcgacaaacgcccggcggccacgaaaaaggccggccaggcaaaaaagaaaaagtaagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaatatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggttgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacgcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 34 - DNA, 10320 bp, Artificial Sequence
  pLMTB7115
gggaccctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttccttaagtcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaatcttttgtgtctgtcgtattgacaacaccgactgcaacaaggtgtagatagaagttggccttctcgctcgctcgcacgctcttcacgctcctgctttccttgctgtgccttgccaccaggatccatgatcgcgagcagcgtgcgccacgcggtgatcctgctgctggtggcggtggcgatgatggtgaacaacgtgatcgcggacatccagatgacgcagagcccgagcagcctgagcgcgagcgtgggcgaccgcgtgacgatcacgtgccgcgcgagccagggcatccgcaactacctggcgtggtaccagcagaagccgggcaaggcgccgaagctgctgatctacgcggcgagcacgctgcagagcggcgtgccgagccgcttcagcggcagcggcagcggcacggacttcacgctgacgatcagcagcctgcagccggaggacgtggcgacgtactactgccagcgctacaaccgcgcgccgtacacgttcggccagggcacgaaggtggagatcaagcgcacggtggcggcgccgagcgtgttcatcttcccgccgagcgacgagcagctgaagagcggcacggcgagcgtggtgtgcctgctgaacaacttctacccgcgcgaggcgaaggtgcagtggaaggtggacaacgcgctgcagagcggcaacagccaggagagcgtgacggagcaggacagcaaggacagcacgtacagcctgagcagcacgctgacgctgagcaaggcggactacgagaagcacaaggtgtacgcgtgcgaggtgacgcaccagggcctgagcagcccggtgacgaagagcttcaaccgcggcgagtgctaatctagaagtcgagggaggaggaggaggcgcgtagcattgcgtgcgggttatgtgtgcgtgcgtgtgtgtgtgcggtgcgcgcctttcctcttttttttctccctctcgtcggttttttttttctgaggagacggggcgaagacgcgagcggggggcggcgtttgtgtgtgtgtgtgcgcgtgtcgggggcagcggtgttggcggaacggccaacgccctgccccctccccgccctgcgacgtttctgcgcacccgttctctccttcctgcgtgcgtgtctgcgcgcatgcacatctgtccgcgtgtgccgcagcgctggtatttttgtgagggcagagccctgcctccccgcctctctgccgttggcaggtgaagcgaaaacgaagcgagagggcagtctgcatgtgtgtgcgagggcatgcggagcccccctccccccgccccctgccgtgctgcaccgctattgtggcgtcttctctcgttgtgcgcaagtgtggctgcaccacggccgcctcatgtgcgtgtgtgcgcatgtacacacacacacacacacacacacacacacgggcaggcgcacgctcctctctcttcagggagcgccgccccgctggtgtcattggacgagcatccgccgcgcatctcttcacccctcacccctcatccctctcccctctccccgcacacacacgcagtccttcgctttcactcttcgaacaaacacctcaaccatcttatcacctttctctcttccttgtcaaccagatctatgatcgcgagcagcgtgcgccacgcggtgatcctgctgctggtggcggtggcgatgatggtgaacaacgtgatcgcggaggtgcagctggtggagagcggcggcggcctggtgcagccgggccgcagcctgcgcctgagctgcgcggcgagcggcttcacgttcgacgactacgcgatgcactgggtgcgccaggcgccgggcaagggcctggagtgggtgagcgcgatcacgtggaacagcggccacatcgactacgcggacagcgtggagggccgcttcacgatcagccgcgacaacgcgaagaacagcctgtacctgcagatgaacagcctgcgcgcggaggacacggcggtgtactactgcgcgaaggtgagctacctgagcacggcgagcagcctggactactggggccagggcacgctggtgacggtgagcagcgcgagcacgaagggcccgagcgtgttcccgctggcgccgagcagcaagagcacgagcggcggcacggcggcgctgggctgcctggtgaaggactacttcccggagccggtgacggtgagctggaacagcggcgcgctgacgagcggcgtgcacacgttcccggcggtgctgcagagcagcggcctgtacagcctgagcagcgtggtgacggtgccgagcagcagcctgggcacgcagacgtacatctgcaacgtgaaccacaagccgagcaacacgaaggtggacaagaaggtggagccgaagagctgcgacaagacgcacacgtgcccgccgtgcccggcgccggagctgctgggcggcccgagcgtgttcctgttcccgccgaagccgaaggacacgctgatgatcagccgcacgccggaggtgacgtgcgtggtggtggacgtgagccacgaggacccggaggtgaagttcaactggtacgtggacggcgtggaggtgcacaacgcgaagacgaagccgcgcgaggagcagtacaacagcacgtaccgcgtggtgagcgtgctgacggtgctgcaccaggactggctgaacggcaaggagtacaagtgcaaggtgagcaacaaggcgctgccggcgccgatcgagaagacgatcagcaaggcgaagggccagccgcgcgagccgcaggtgtacacgctgccgccgagccgcgacgagctgacgaagaaccaggtgagcctgacgtgcctggtgaagggcttctacccgagcgacatcgcggtggagtgggagagcaacggccagccggagaacaactacaagacgacgccgccggtgctggacagcgacggcagcttcttcctgtacagcaagctgacggtggacaagagccgctggcagcagggcaacgtgttcagctgcagcgtgatgcacgaggcgctgcacaaccactacacgcagaagagcctgagcctgagcccgggcaagtaagctagccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagcctaggactcgagtagtatgaagatttcggtgatccctgagcaggtggcggaaacattggatgctgagaaccatttcattgttcgtgaagtgttcgatgtgcacctatccgaccaaggctttgaactatctaccagaagtgtgagcccctaccggaaggattacatctcggatgatgactctgatgaagactctgcttgctatggcgcattcatcgaccaagagcttgtcgggaagattgaactcaactcaacatggaacgatctagcctctatcgaacacattgttgtgtcgcacacgcaccgaggcaaaggagtcgcgcacagtctcatcgaatttgcgaaaaagtgggcactaagcagacagctccttggcatacgattagagacacaaacgaacaatgtacctgcctgcaatttgtacgcaaaatgtggctttactctcggcggcattgacctgttcacgtataaaactagacctcaagtctcgaacgaaacagcgatgtactggtactggttctcgggagcacaggatgacgcctaactagcctcggagatccccatggcctcaggtctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctctgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcacgatatttaaatggtacctatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttgggaccctatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 35 - DNA, 4073 bp, Artificial Sequence
  pLMTB7186
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtaccgctccggccccttccgggtccagtattcctcccgggactccttcaaggtcctggcccggaacctgggcgtcatggacgacctgaagtccggcgtcccccgggccggctatcggggcgtcgtctccttcatctcccggggccggcggatctatctggccccccccgagggctggaccaagtatgacgtctcctggtcctaattagcgctccgtagctcgctgcgtatgagaggtactgagctccaatgcatcacacggcgtacggcaacacacactatcttttcagtttatttttttaattatccctccaaaaagaagcaactgacacttcaaaatattcccaacaaggagcgtgaggtcagtgaccagtctcggacttcacaccgcgcatgtagaagcacgcggcttgcgcgccaggcttcttttggcaaaccacgctgcacagaatgtctgtgtacagcagccaggctgtgatcgatctattatgctcgcccctcgctcctccggcattctcgagtccatgtcgagcttgtctggctccgtgcacatgcaagcgtttgtgcgcgcctctaatgtaaccacacgtcaaaacattgtgtgtcttccgaagtgggagacaccggggccaccaactccggtggtttacagcctcctccctcaaccaacgctgccgattgtaccacctttcattgcgtctttgtgcccctccctatcttcatgtttccactgcgcttcgtttccgaatactattttcgtgtactgtttcatcactttctcacaacagctcttttttttcacccgcaggccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtccggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 36 - DNA, 3674 bp, Artificial Sequence
  pLMTB7805
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatcctgcaggtgaaatggtgtatcccatgacacgtcttacgtcatgttcctccctccttcgtatgcgtacgactctcctccgcctccgcctccgcctccgcctccgcctccgcctccgccttctctgcgccggtttcctggaggatggagagctcttgctcatagattgaagaaagaccaggcaagccacggaaaactccgaacaaaagcggactcacgcggccgtctgcatttgacgtgcttgcatacatatacgcaccaaccttgtgcacgtcttgttgacatccgtaacacttgcctcattttttccgtgctgctcggatgcacactcctggtgtggggcgtagtcactattcgtctctcaccaacacacacacacacacacacacacacctgtacatctctctctctctccttttctgtgtgccccggcggacgtgcgtgcgtgtctaatcactgaaattcttcacattgcatagaacgtagcgtcaggacgcagcctcgaacggcgatgaagccagaactcgagagtatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggttgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggattcgaaatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 37 - DNA, 3794 bp, Artificial Sequence
  pLMTB7807
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatttaattaagaggcagcgcggctatcgtggctggccacgacgggcgttccttgcgcagctgtgctcgacgttgtcactgaagcgggaagggactggttgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacgcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgacctcggagatccatggggtgtgctttccaggccgctgagcggagaggtgcggagggcagtccaggaaggtggggagggaggagggatggtacccaagcgagaaggggacggacgagctcaaggctgaaagtttcagccaacggtttccggcgctgcatccgttctcatgttttggcactcgtcatatgcttttatttctgtaatcgtttttggaggagggaggaggggaggagatgtgggcgagcagagacggcggcagcagcaaaaaaaagggggggcgcccaccggcgctggtgaggcgtgcagggggaagagggtggcatgcgacatgcacaaccaaacgtgcgcgtgtgcagatgtgctggcgtgcgtcgtgagtgtgtgatttatttttgaatgacaccttatcattgctctctctgcctcacactctctcgcttccaccgctttaccttgctacgagtgtcgcttcggtataccgtcactgacgttgcctctcccctctccatactttcgcctgcaggatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 38 - DNA, 3794 bp, Artificial Sequence
  pLMTB7811
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatttaattaagaggcagcgcggctatcgtggctggccacgacgggcgttccttgcgcagctgtgctcgacgttgtcactgaagcgggaagggactggttgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacgcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgacctcggagatccatggagggagaatgatgatgtgaccgaggtggcgcgctcgcacgtgtcctcctcctccccctcctcctcctcttcttcttcctcctcatggccgccctctgcggtggtcctctctcaccttttcatgtgttcctgtgtggcgtgcgtgtcgctcaggggattcccgtgtgtgtgtgggggggggggatgccggccactggggcgtggggcgtgcgggcgcggcagcaggctctcgaggtgatggctggttggactcttggcgtggggggcggtgcgggtgtccgttggttgaccggcccgtagtggagcacgggcacaagtggacaccggcaggaacgttcctgctggtcactgtttcgatactgctttcctcgtcaccctgtgcgtcgctctctgtgcccctctcctcccctctctgtctctgtctctctctctgtgtgagtatgtgtgtataggtgggggggggagagagaagctgtgcgtgtgcacggtggtattgtgtggcctgcaggatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 39 - DNA, 3661 bp, Artificial Sequence
  pLMTB7812
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatcctgcaggctctctcgtgctggacgcctctgcaccactgcgtcgcacacgaatcgccggtagtgatggtgctttttcgtacaccgatgcgcgcgagcacctccgctcttgccgcgtccttctgagctttgctgctacgcgtcgccgtggcgtccttccatcgtgttgcttttctttcaacgttccttctgcagcgatgcgactggcatccccttcgtattagcaccagcaccaacaacacggcagctgcgcgcacttttgtcgcacgtgactgcgcgaccgcgatatctgctttccattctgcagttctctacacacttctttgtgtctttccttcccccctttcgagcgcacacacgcgggcgcgctcagaatccgcctcgcctgctgtcctcctgtgggcgcgcgcgtaatcgggcacgcgtcaggcagcgccacagaggcctgcccagacagcgaacgggtccatcggacaccctcggtccccggcattcgcaggactgtgggtcctcgagagtatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggttgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggattcgaaatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 40 - DNA, 4439 bp, Artificial Sequence
  pLMTB8223
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatccacacaataccaccgtgcacacgcacagcttctctctcccccccccacctatacacacatactcacacagagagagagacagagacagagaggggaggagaggggcacagagagcgacgcacagggtgacgaggaaagcagtatcgaaacagtgaccagcaggaacgttcctgccggtgtccacttgtgcccgtgctccactacgggccggtcaaccaacggacacccgcaccgccccccacgccaagagtccaaccagccatcacctcgagagcctgctgccgcgcccgcacgccccacgccccagtggccggcatcccccccccccacacacacacgggaatcccctgagcgacacgcacgccacacaggaacacatgaaaaggtgagagaggaccaccgcagagggcggccatggggaggaagaagaagaggaggaggagggggaggaggaggacacgtgcgagcgcgccacctcggtcacatcatcattctccctgcgtggggatggatcgcgagggacgcggggtttgagggccgtgggtggtgtggagagtgtggttgattattgtatggtggtgagggtggaaggtgtggcggggatggtggtgcggtggtgtcggaaggggtgtgtgagagggcgcgggtccttgagggagggtgggtgtgttgttgttttgcgggtgttatccggggcttgggtgttggtgtgattggtgactatgtaggggtgaagggtgagtggagggggtcgccagaggcgttccgttctacgaagcttcattcctatgtccgactccgaagcatgcctgcagttctgctggctatgtgggcgtgtctgggcaacgactgaattgagaaggggagtcgaaacggtgcgtggatgctgtgtttgtgctacacacaagcaaaggcaacaacacaagcgcatcgagccagacgaaccaacccaatattcacacaactgtacgtggccgcgcgctgtatctccgatgggatgatgcgtgtgcgtgtgccaccaccacgtactagtttccagccttactgcttgtataccttgtcttttgcgttgtgcttgcgcgtgctgtgtacctctgctcgtgcgttccgtatcccgggacctgcgggcggtgggtgccacacaacccgtcacattcaacatcactcatacatctcaccgatgtgtgcgtgtgcttgctgtgtgcgtgtgttgtgtggcgtcaaacctgtttgaaaacacacccctagcactattcgaccgcgaaagcgcccccccaaaggggccggtgtgcaatgcgagctacatgtatgtgtagagagcgctgcgccgaactagtcgtgcgtgctgaacatgttttgtgtgtgctgccgtgtctacacgtttgcagcggaaactcggttgaaccagaaacagaacttgattgttgctgcatttcgaggaatttcagccaaacaagaggtcaacaaccaagccgcgtgtacacatatacacacaccgcgtgtatgtatatatgcgtttgttttgttaccacaaatactgagttgtctgatgtgagcttctgctacagacgcaattcaggaaatacaacaaaatacaacacttgatcatcaatgcgcaatgtgcgcgtgttgtgtgtgtgtgtgcgagcgcacacacacatgcacacgactcacgttgtcacacaattgagagctctctcttctccttcccctctctctcctctctcctctctccagagctctctcttctccttcccctctctctcctctctcctctctccagagctcgagccaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 41 - DNA, 4268 bp, Artificial Sequence
  pLMTB8225
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatcggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacgcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgactagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaacccccgcccccgttatataacgtgaagtacccagtcaagagcggatacggggggggagcactgccacttgaatttgggtcaaggtggcacagtgctcctgttgctagtttgttctccgcacagtcttattaggaaacgagaaagcgtcaatatcatactccacatgtgttcgtgctccactaccgaccggccaaccaacggacacccgcaccgcccccccccacgccaagagtccaaccagccatcacctcgagagcctgctgccgcgcccgcgcgccccacgccccagtggccggcatcccccccccctcacggtggaggagggtgcggaggatgtcgcatcgaacagcagagataagtgaagcagcatgcgcaggtgttggcgggtgggtgagtccgcgcctacacggaatcgactccgtagacgccaagtgccacggcggcggcggagcacaacgcttggctgttgggggcgggggggggggggggggggtcaagacatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 42 - DNA, 4379 bp, Artificial Sequence
  pLMTB8229
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatcgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagctagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaagacccacagtcctgcgaatgccggggaccgagggtgtccgatggacccgttcgctgtctgggcaggcctctgtggcgctgcctgacgcgtgcccgattacgcgcgcgcccacaggaggacagcaggcgaggcggattctgagcgcgcccgcgtgtgtgcgctcgagaggggggaaggaaagacacaaagaagtgtgtagagaactgcagaatggaaagcagatatcgcggtcgcgcagtcacgtgcgacaaaagtgcgcgcagctgccgtgttgttggtgctggtgctaatacgaaggggatgccagtcgcatcgctgcagaaggaacgttgaaagaaaagcaacacgatggaaggacgccacggcgacgcgtagcagcaaagctcagaaggacgcggcaagagcggaggtgctcgcgcgcatcggtgtacgaaaaagcaccatcactaccggcgattcgtgtgcgacgcagtggtgcagaggcgtccagcacgagagagatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 43 - DNA, 3995 bp, Artificial Sequence
  pLMTB8234
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatatgcggttccggatttacaagcgcaaagtggtcatcttgaccctcgtcgtgattatatgcggttttgcagtgtggaacagtggcaaaccgaagaaggccagcacggtgtttccgaaagaggtggagacagtgaagcgcagtagtgtgggcagccaaatccaggcgaccattcctgtcacgcggaagccgatcaacgagtcgatcccagagaagcagcagcagcaacagcctgtggcaaagtctgaagcagacaacacgacacttgtctaccggggcatcgtgttccagttgaactttgaccagaacctcaaaaacgaggagaagtttcgagcggttcgccagaaggacgacctggttatcgtcgtccaggtgcacaaccgcccggagtatctgcgtcttctggtggatagcttgcgaaagagcaagggtattgagaacatactccttattttcagccacgacttctggtcgcctgagatcaatcaaatcgtagcttcggtagatttctgcctcgtgctgcaaatcttctttccattctccatccagttgtatccccaagagtttcccggcaacgacccccgagactgcccccgcgacatccctaaaaaggaggcactgacacttggctgcatcaacgcagaatacccggattcatttggccactaccgcgaggccaaatttagtcagacgaagcaccattggtggtggaagctgcattttgtgtgggaccgggtgcgggtgctgaaggaccataaggggctggtgctgctgatcgaggaggaccactacctcgctcccgatttctaccaccttctgaagctgatggcaagtctcaagaaggagcagtgccctgactgtgatatactctctctggggtcgtatggccacatcggctactcatcaaaggcaaataaggttgaggtcaaggcctggaagtccacggagcacaacatgggcatggccctcaaccgcgatgcctaccagaaactcctccgctgcacggacgcgttttgcacctatgatgactataactgggactggagcctgcagcatctgacagtcacgtgtctgcccgcgtttctcaaggtgatggtttcggaggcaccacggatatttcacgctggcgactgcgggatgcaccacaagaagtctgcctgcatgccgagcggccagaagacaaagattgagaacgtgctccagaatagcggtaatcagctcttccctaagcagctcttgatcacgaagcgactgcccgcgtcgggggcgaagggcgtagccccccatgtgaagaacggcggttggggcgacatccgggaccacgaactgtgcaagtcttacctgcgccttcagtagatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 44 - DNA, 3989 bp, Artificial Sequence
  pLMTB8238
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatatgctgaagaagagctcgctcgtgctgtggggtgtggtactgttcgtggcatggaacgcccttatcttgttcttcctgtggactcgaccgcaaagcctctccgatcacagccatctcacggaggaggtgattcggcttgcgcaggatgccgagtctgaattggagcgtcagaaggacctgttgcagcagatctaccgttattctgcactgtggtcccggcgcaaggcgtccgaagccaagctccatccgccggtcgccgcaagtgcgcagccttcaacggcggcacccctcagccatcactcgcagatcagcccggatgcggttttgccagtgctcgtgatcgcgtgcgatcggtcgacagtccgtcgctgcctggacaagttgctgcactaccgcccgtcacaggagcgtttcccaatcatcgtgtcgcaggactgtgggcacgacgagacagcgcgagtcatagctagttatggcgacgccatcatgcacatcaaacagccaaacttgagcgacattccggtgccgaccgaccatcgtaagttccagggctactacaagatcgcgcggcattaccattgggcactctcacaggtgttccgtacgtttcagtatcaggcggcgattgtcgtggaggatgacttggaggttgcccctgatttcttcgagtactttcaagctgcctttccgcttctcctggcagacccaacactgtggtgtgtctccgcgtggaacgataatgggaaagagcaaatggtggatgccgcgcacccagatctgctctaccgtaccgattttttcccggggctcggatggcttctcctgagcgatttgtggaacgaactcgagcccaagtggccaaaggccttctgggacgactggatgcgacagcctgagcagcggcagggacgatcttgtatacgcccagaggttagccgaactatgactttcggtcgaaagggcgtctcccacgggcagttttttgatcagcacctcaagtttatcaagctgaacgatcacttcgtcccattcacccaaatggacctcagctacctcaagaagaacgagtacgaccggtcttttctggaccaggtgtacggtgcacccgagctgcgagttgaggagcttcagggtaaccggcgccgcgagctgggcacggtgcgagtgcagtacacaactcgcgactccttcaaggcgttcgctaaggcgctgggtgtcatggacgaccttaagtccggtgtgccgcgtgccggttaccgtggcatcgtttcgtttctctatcagagccgccgggtctatctggccccgccttccgactggacaggatacgatcccagctggagctagatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 45 - DNA, 3854 bp, Artificial Sequence
  pLMTB8287
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatgctgggcacggtgcgagtgcagtacacaactcgcgactccttcaaggcgttcgctaaggcgctgggtgtcatggacgaccttaagtccggtgtgccgcgtgccggttaccgtggcatcgtttcgtttctctatcagagccgccgggtctatctggccccgccttccgactggacaggatacgatcccagctggagctagttcctttcacctatacacgtggttcatatattatcggctttttacctgagagagcaaagaaagcttattagcacggaaaaacgtaatgtgctgataggggaaagaaacaaaaacaaccgcagccgagacattttgtttgtgttggaggaagtagaggaggcccatcggtgtctagaagacaataccgcagtgtgagacagtgacagaggtggcagaggagaggtagggggaagctcaaatgagtgctgtatcatgtatgcatgtctctctggctgcttctcagcttttcgttccggcttccactggactgtggccctgctccaaaccttcgacgtgggatgattcgatgactctttcttttatcagtgactgataccgatactgtgctgcagagaatcgagaaaaaaagcggaaaaggcggcagggcctcgatggcaaatcgtttagttgtgtgtgtcagtgatgcctctctaggtggcggagtggggctgcacgtgatggacgacgacgtagcgcaatacgcgccttcagtcgacagatcgaacaagcaccgtgctggtttcagtatccctgcgcactctcctggttatgggcgccttgaatgcgagcctttgtttgagctccacttgctgctcatcaaatggccacacttccgacctcccttgctctttttttttgcacttttgtggcacctgtgtccttgctgtcggtcctttccaacttcagcacacggagaaaccaccctgactgtagcaatcacgatccagtggggacaaaggagacgaggtgtcgagtgccatttcgacgatcggaatgcgaccacgtaagaccatactgctcgtgggtgtcctggtgatatgggtgcttatgacctaccttgcctttatgcggagcgttcggggcacagacgggtcgcgcccacgcccggctttcgccagtaataagctcatgctcgagaaggtacaggatttcgagcagaacctgaagtcgttcgccgacagccgtcagaatctatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 46 - DNA, 3997 bp, Artificial Sequence
  pLMTB8301
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatgcagcggccccttccgagtacagtactcgagccgagacagtttcaaggtccttgcccgcaacctcggggtgatggatgacctgaagtcaggcgtgccacgcgccggttaccgcggcgtggtctcgttcatatctcgcggccggcgcatctacctcgcgccccctgagggttggacgaaatacgacgtgagctggagctaatgaactgcctgtcgcaacgaccacggccctctcgctttcccttggttggttcgtcaaacggctgaaccggcttctcttcctctgtcgctccttgtcctcatttctgtttcacacgacatacttgtctattatgtcgctgcctgtatgtgtgtgtgtgtgtgctgcaatgacgggtagggggctgaggcggcaaggtaagcaggggcgccgaggcacgggtagaggccaaaggcaggcgtcggcgatgatggaccttcctcgactttcttcgttgtggtcttatctttgctcgtttcaattcttgttttcatttctcgtcgtctgaaaagaaaggcaaaaaaaaacaaagaaggggcgcagaagagcgggatcgcgacgtgcgtacacgtatcgaggtcgcttcccttttttgcgaagtcttttcgacctctcgtacacatctttcgtgggctgttgtgcaccatgttcagcgcgcgacgtcgagctgtgctcgcttcctgcaatgacttcccgcccttcgtctttgtcttccactggaagagtgtggcacttcactcgccagtgatgaggggaagggggagcggaccaacaccgtcttttttatagcgataaggaggtgaggaggtggtctgtgtggcgttcctcgtgatgataggcttcatggtcgacttacttaccgcgtgaggagcagcatatccatccacctccaagttcctcgaagaggtcaggaaacgccacttctcatgccccgccagtctcttgtgtaaccttcgtccctcttattcttcatctcactcatccgtgcctcgttgaccacttcaccgtaacccgctccctccctttcaatctctcctgccccccccccccccacacacacactatcgctcactcgcgcccctttgttcgtgtttccctccctatcatatgcgtgcgcattccataaagtgttgcaatcatgcggttccggatttacaagcgcaaagtggtcatcttgaccctcgtcgtgattatatgcggttttgcagtgtggaacagtggcaaaccgaagaaggccagcacggtgtttccgaaagaggtggagacagtgaagcgcagtagtgtgggcagccaaatccaggcgaccattcctgtcacgcggaagccgatcaacgagtcatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 47 - DNA, 4417 bp, Artificial Sequence
  pLMTB8381
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaataacacttgatcatcaatgcgcaatgtgcgcgtgttgtgtgtgtgtgtgcgagcgcacacacacatgcacacgactcacgttgtcacacaattgagagctctctcttctccttcccctctctctcctctctcctctctccagagctctctcttctccttcccctctctctcctctctcctctctccagagctcgagccaccatggtccgcaagaagggatctctgatcctgtgtggggcgtttctgttcgtggcctggaacgcgctcttgctcctttttttgtggggccgcccgcccattggtcgactcggcgagggtgggggggcggagccgggcgcgggcgaggagtggggtgcggggaagagcaaagtgggtggcgctaacggcctggcgggtgaggttatccgcctggcggaggaggtcgagagtgagctggagacgcagaagaagcttctgaaacagatacagtcgcaccgcgagctttgggaacagcgtaaggaactggagaagcgtgaaagcgaggataccaaggacgagaagattgacgttgagcctaagaagccccgccagatcccggccgtgcacctgtcccacaaggtggtggaagacgcccagacagtaaccaagaaaatgcaaacgctgatggtgacaccgcctcagctggtgatgaaggagcaggagacagatcagaagaataagcagatgatggaggaccagctggggctcaccacgccatctccgcaaatcatcatcccgattctcgtgatcgcgtgcgatcgcgtgaccgtgaagcggtccctcgaccgtctgatccagtaccggccaagcgcagagttgtacccaattatcgtcagccaggattgtggccacgctgacacagcccgcgtgatcgggtcctatggcagccagatcacgcacataagccagcctgaccttgcagatataccggtgcggccagatcatcgcaagtttcaggggtactacaagatcgcccgccattaccgttgggcgctcaaccaggtgttcaacgtgtttgcctactcaacggtggtgatagtcgaggacgacctggaggtggcgcctgacttcttcgagtactttcgagctctctatccgatcttgcgctcagatcctaccttgtggtgcatttcggcttggaacgataacgggcgtgatggtctcgtggatcccgggaaggccgagctcctctaccgcacggacttctttcctggactgggttggatgttgcttaaggaggtgtgggcggaactcgaacccaagtggccaaaggcgttctgggacgactggatgcgacacccggagcagcgtaaaaatcgctcttgcatccgaccggaaattagtcggacgatcacattcggtcgtaaaggtgtgtccttggggcagttcttcgaccagtatctccgttacattaagctcaacactgaattcgtccctttcacgaagcacgacctcagctatcttgtgcgagagaagtacgatgttagctttgaaaaagatgtatactcggctcccctcgtaaaggtagaggagctgcagcacggcggcagccttaagggcagcggccccttccgagtacagtactcgagccgagacagtttcaaggtccttgcccgcaacctcggggtgatggatgacctgaagtcaggcgtgccacgcgccggttaccgcggcgtggtctcgttcatatctcgcggccggcgcatctacctcgcgccccctgagggttggacgaaatacgacgtgagctggagctaaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 48 - DNA, 4243 bp, Artificial Sequence
  pLMTB8383
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatatgcgaccacgtaagaccatactgctcgtgggtgtcctggtgatatgggtgcttatgacctaccttgcctttatgcggagcgttcggggcacagacgggtcgcgcccacgcccggctttcgccagtaataagctcatgctcgagaaggtacaggatttcgagcagaacctgaagtcgttcgccgacagccgtcagaatctgtatcgcgacatcattaacatcctgcgccggacagacaaggtgagttctgtgccagctcagccgataccggctgtaccgtcgcaagagtcccctggcgcggccgtgcaggagagcgaggtcccgaaggagcgccaagcgccgccgcaacgctacctgaacaacgatccagccttcccggtgatccctgtggtcgtttttgcttgcaaccgcatttctgtcaacaagtgccttgacgatcttatccgctatcgaccctcggccgaacaattccctatcattgtgtcacaagactgtgacgatgaagcgacgcgtaatacgattctgagctaccgtgacgaagtgactctgattcagcagcctgaccagtcagatatcccggtgccgcctaaggagaagaaatacaagggctactacaagatttcgcggcactacggctgggcgctccgcgcagtgttcggtcaaggcttcgattccgtcattttggttgaggacgacctctcggttgctcctgacttctacgaatactttctcggaacctaccctatcctgaagcgtgataagtccctctggtgtgtatccgcatggaacgacaatggcaaggagggtctcatcgacacgacggcgcacgaccttttgtaccgctcggatttttttcctggcctgggctggatgatgacaaaggatttgtgggacgagctggagccgaagtggccaaaggcgttttgggacgactggatccgccagccagaacaacgcaaggagcgcgcctgcatccggcccgagcttccacgtacccgcacgttcggcaagatcggcgtttctaacggcctgttttttgacaagcatctgaagtttattaagctgagtgaggagttcgtgtcctttaccaagacgaaccttagctacctcgtgaagagtgcgtacgatgatgcgtttctgaagacagtgtaccaaagtcctgtagtgactcttgacgagctcaaacggggcatggtcatgacacgcgagccaattcgtatcgcttaccatacaaaggagcagtataagcgcgccactaaaaacctgggtctgatggacgacttcaagagcggcgttcctcgtacggcttaccgcggcgtggtgtcattcttttataatggccaacgggtatatctcgcgccctctgcgaactggaagggctacgatcttacgtggtcgtgaggtagactcgtgccgcgcgctgatgatgtaggtgcacgcgtgcgtgtgctgcagcggagccgccgccaccgcgactgtgtgtgtgtgcgcgcgtgacgaccggctcgaggaaggaggagcgcgcgtgtgcgtgcgatgcgcctcctctttttttttcgccctcgtcggtttttttttttctgagaggacggcggcggcggatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 49 - DNA, 4174 bp, Artificial Sequence
  pLMTB8384
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtagactcgtgccgcgcgctgatgatgtaggtgcacgcgtgcgtgtgctgcagcggagccgccgccaccgcgactgtgtgtgtgtgcgcgcgtgacgaccggctcgaggaaggaggagcgcgcgtgtgcgtgcgatgcgcctcctctttttttttcgccctcgtcggtttttttttttctgagaggacggcggcggcggatggcggggcggcggcgctgacggagcggccacgctctgcacctccccgccctccgccgtctctccgttcgccgtcctctccttcctcgtgcgtgcgtctgccgcgcatgcacacgcgcgcgcgttgccgtagcgctgtgtatctgtggaggagggccttgtctctccctccccgtcgctgagagatgaaggggcaaaaagagagagcagtgcgcatgtgtgcctccgctccctggagctccccacgagccccctgcgccacgcacctgcgaacctgcacagcggcccacctgcccgcacacgtgagcagaaatgggtgtgtggagcgggtgatgtcggcgcgcacacgcgcgcgcgctgaccactccgacgtgaaaacacggaagagcgaggctggcaaggcagggcaggaacctgatcacgtgcgcgcgcacaaacggaatgagcagctcctgaagaggagatggggctcatgcacgcagacacgcacgtgcacactcctccgtcttcacggagcgcggccctgctgctgctgccatgtgccggacgtctgccacgcgtctcttccccacaccttgctcttcccccccccccttccctcccggcgaacacaaaacacgcgcacgcccaccgaaacaacaacgcgcagctcttcgctctcgttcttcgaacaaacacctttaaaccgccttccaacccctctttcttctttttcagccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 50 - DNA, 3387 bp, Artificial Sequence
  pLMTB8629
ctgcatgccgagcggccagaagacaaagattgagaacgtgctccagaatagcggtaatcagctcttccctaagcagctcttgatcacgaagcgactgcccgcgtcgggggcgaagggcgtagccccccatgtgaagaacggcggttggggcgacatccgggaccacgaactgtgcaagtcttacctgcgccttcagtagcgagcgcgttgcctctgcgctggtgaacgtgcctgcgcacttacatctcagccgtgctttctgggaagaccttctgcgacgcggggcgctgtgctggtacagatggaaagatgtgcgccatcacggatgcatccttgcatggtgcgtgctcacgtgctcaccacagtttgtgtgtgtgtgtgtgtgagtgtgagtgtgagtgagagagagagtgtgtttcggcgcacctcccatccaacagtggcgtgaacggctttctctgtatgcgccctttcgttttaactctttctttttccgcctttgttttttgtgatttttgatgaactcaaacacaaaatgaacatccatgctgaagaagagctcgctcgtgctgtggggtgtggtactgttcgtggcatggaacgcccttatcttgttcttcctgtggactcgaccgcaaagcctctccgatcacagccatctcacggaggaggtgattcggcttgcgcaggatgccgagtctgaattggagcgtcagaaggacctgttgcagcagatctaccgttaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 51 - DNA, 4721 bp, Artificial Sequence
  pLMTB8640
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatacctcgagagcctgctgccgcgcccgcgcgccccacgccccagtggccggcatcccccccccctcacggtggaggagggtgcggaggatgtcgcatcgaacagcagagataagtgaagcagcatgcgcaggtgttggcgggtgggtgagtccgcgcctacacggaatcgactccgtagacgccaagtgccacggcggcggcggagcacaacgcttggctgttgggggcgggggggggggggggggggtcaagacaccactgcgcaccatacatcaggagagctgaagcaccgggcgcgttgatgcaccttcgcgtgtgacgccgaggaggaggtccagatgatgcgtcggcgccgatgcgccaggcttaccagagaaagcagacgatcgatggcgtacgatgtttctgatgcacaacgcatgcgctggttgcgcgtgcgccgagatccaggtcgttgtgcaggaggtcctcgcaagttggggacgatatccctgcatgcggcgtggggatggatcgcgagggacgcggggtttgagggccgtgggtggtgtggagagtgtggttgattattgtatggtggtgagggtggaaggtgtggcggggatggtggtgcggtggtgtcggaaggggtgtgtgagagggcgcgggtccttgagggagggtgggtgtgttgttgttttgcgggtgttatccggggcttgggtgttggtgtgattggtgactatgtaggggtgaagggtgagtggagggggtcgccagaggcgttccgttctacgaagcttcattcctatgtccgactccgaagcatgcctgcagttctgctggctatgtgggcgtgtctgggcaacgactgaattgagaaggggagtcgaaacggtgcgtggatgctgtgtttgtgctacacacaagcaaaggcaacaacacaagcgcatcgagccagacgaaccaacccaatattcacacaactgtacgtggccgcgcgctgtatctccgatgggatgatgcgtgtgcgtgtgccaccaccacgtactagtttccagccttactgcttgtataccttgtcttttgcgttgtgcttgcgcgtgctgtgtacctctgctcgtgcgttccgtatcccgggacctgcgggcggtgggtgccacacaacccgtcacattcaacatcactcatacatctcaccgatgtgtgcgtgtgcttgctgtgtgcgtgtgttgtgtggcgtcaaacctgtttgaaaacacacccctagcactattcgaccgcgaaagcgcccccccaaaggggccggtgtgcaatgcgagctacatgtatgtgtagagagcgctgcgccgaactagtcgtgcgtgctgaacatgttttgtgtgtgctgccgtgtctacacgtttgcagcggaaactcggttgaaccagaaacagaacttgattgttgctgcatttcgaggaatttcagccaaacaagaggtcaacaaccaagccgcgtgtacacatatacacacaccgcgtgtatgtatatatgcgtttgttttgttaccacaaatactgagttgtctgatgtgagcttctgctacagacgcaattcaggaaatacaacaaaatacaacacttgatcatcaatgcgcaatgtgcgcgtgttgtgtgtgtgtgtgcgagcgcacacacacatgcacacgactcacgttgtcacacaattgagagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 52 - DNA, 12515 bp, Artificial Sequence
  pLMTB8777
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtaccagcaagcaggcgctgtggggtttatccacacagaagagaaaatagggtccgtgaagcctgcctacaaagggcgtggaatgataaacacgacgtacaagaacatgccgagcagggcaccaacaaatgggacgataaggggtaaccaaaagtagtggtcgtgcaacgtgaagggctctgagccccagagcatcgcggagaggacgcgaggtgcaaagtcacgtgcgggattgaggcaataccctgagttaatgcctgtagtggcaccaataaccaccagcagcagcccaatagccaccggcttgtagtttgtagccggcgtcatgcggtcatctgtaatggcgagaatgcccatcagtagtgccatggtgttgaacacctcgctccacaccgcatagccggtcgccaccttcgggtaggtgacgaagatcccgccatacttggacgccatcgtctctgttggaagtaagttcctctcgccctcgtcaaagtgggacttgaactacgtagcgtggggatggatcgcgagggacgcggggtttgagggccgtgggtggtgtggagagtgtggttgattattgtatggtggtgagggtggaaggtgtggcggggatggtggtgcggtggtgtcggaaggggtgtgtgagagggcgcgggtccttgagggagggtgggtgtgttgttgttttgcgggtgttatccggggcttgggtgttggtgtgattggtgactatgtaggggtgaagggtgagtggagggggtcgccagaggcgttccgttctacgaagcttcattcctatgtccgactccgaagcatgcctgcagttctgctggctatgtgggcgtgtctgggcaacgactgaattgagaaggggagtcgaaacggtgcgtggatgctgtgtttgtgctacacacaagcaaaggcaacaacacaagcgcatcgagccagacgaaccaacccaatattcacacaactgtacgtggccgcgcgctgtatctccgatgggatgatgcgtgtgcgtgtgccaccaccacgtactagtttccagccttactgcttgtataccttgtcttttgcgttgtgcttgcgcgtgctgtgtacctctgctcgtgcgttccgtatcccgggacctgcgggcggtgggtgccacacaacccgtcacattcaacatcactcatacatctcaccgatgtgtgcgtgtgcttgctgtgtgcgtgtgttgtgtggcgtcaaacctgtttgaaaacacacccctagcactattcgaccgcgaaagcgcccccccaaaggggccggtgtgcaatgcgagctacatgtatgtgtagagagcgctgcgccgaactagtcgtgcgtgctgaacatgttttgtgtgtgctgccgtgtctacacgtttgcagcggaaactcggttgaaccagaaacagaacttgattgttgctgcatttcgaggaatttcagccaaacaagaggtcaacaaccaagccgcgtgtacacatatacacacaccgcgtgtatgtatatatgcgtttgttttgttaccacaaatactgagttgtctgatgtgagcttctgctacagacgcaattcaggaaatacaacaaaatacaacacttgatcatcaatgcgcaatgtgcgcgtgttgtgtgtgtgtgtgcgagcgcacacacacatgcacacgactcacgttgtcacacaattgagagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctaccatggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagcgcaccgcccgccgccgctacacccgccggaagaaccggatctgctatctgcaagagattttcagcaacgagatggccaaggtggacgacagcttcttccaccgcctggaagagtccttcctggtggaagaggataagaagcacgagcggcaccccatcttcggcaacatcgtggacgaggtggcctaccacgagaagtaccccaccatctaccacctgcgcaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgcccgcctgagcaagagccgccggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgcgcgtgaacaccgagatcaccaaggcccccctgagcgcctctatgatcaagcgctacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaaccgcgaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggcccgcggaaacagccgcttcgcctggatgacccgcaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgcgcaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggaccgcgagatgatcgaggaacggctgaaaacctatgcccacctgttcgacgacaaagtgatgaagcagctgaagcggcggcgctacaccggctggggccgcctgagccggaagctgatcaacggcatccgggacaagcagtccggcaagacaatcctggatttcctgaagtccgacggcttcgccaaccgcaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggcccgcgagaaccagaccacccagaagggacagaagaacagccgcgagcgcatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgacccgcagcgacaagaaccggggcaagagcgacaacgtgccctccgaagaggtcgtgaagaagatgaagaactactggcggcagctgctgaacgccaagctgattacccagcgcaagttcgacaatctgaccaaggccgagcgcggcggcctgagcgaactggataaggccggcttcatcaagcgccagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagcgcaacagcgataagctgatcgcccgcaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaacgcagcagcttcgagaagaatcccatcgactttctggaagccaagggctacaaagaagtgaaaaaggacctgatcatcaagctgcctaagtactccctgttcgagctggaaaacggccggaagcgcatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagcgcgtgatcctggccgacgctaatctggacaaagtgctgtccgcctacaacaagcaccgggataagcccatccgcgagcaggccgagaatatcatccacctgtttaccctgaccaatctgggagcccctgccgccttcaagtactttgacaccaccatcgaccggaagcgctacaccagcaccaaagaggtgctggacgccaccctgatccaccagagcatcaccggcctgtacgagacacggatcgacctgtctcagctgggaggcgacaaacgcccggcggccacgaaaaaggccggccaggcaaaaaagaaaaagtaagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaatacgtagcccgtaagtattggcggcaccaacaaaagctcccagaaactgagcgagaaaatagcctggtagcttcttccaagggaacccggcaaacacgcagtttgccagcgtcacagccgggttcaagtgaccaccggacacacccatggtcaggaaaaggctgatggtcagccccaaaccccagccaaagttgatagccaggtagctcgggttcgactggccggcgccagtggcaccagcgttgaacacagtggtcgccaccacgccggtgccgaaggcaatcaggaaaaacgttccaaagaactcgctgaagtactcgcgtaactgccatcggaactcgtagagaggccatttgctctgtgacatccagttccatttgctctccttctcctgcggatcttcctcattcatgtgaactccagtggccacctcgtccgggtcctctttttgctcatataactgagcctcgacatcgtattgcgagggagccgtacctttatgcgcgggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 53 - DNA, 24 bp, Artificial Sequence
  oLMTB4952
ccgatggctgtgtagaagtactcg

SEQ ID NO: 54 - DNA, 35 bp, Artificial Sequence
  oLMTB6043
gctcagctgcgagagcgtaaacctccgtaacaatg

SEQ ID NO: 55 - DNA, 35 bp, Artificial Sequence
  oLMTB6044
agctaaactctgcactcatctgcgcttccgcaagg

SEQ ID NO: 56 - DNA, 35 bp, Artificial Sequence
  oLMTB6045
actatcatgccctacgtgggccacgcagcgatgag

SEQ ID NO: 57 - DNA, 35 bp, Artificial Sequence
  oLMTB6047
gcgtctcaccgcttgccaggtcttctactccaatg

SEQ ID NO: 58 - DNA, 24 bp, Artificial Sequence
  oLMTB6073
tggtggaggagggtgcggaggatg

SEQ ID NO: 59 - DNA, 35 bp, Artificial Sequence
  oLMTB6154
atctggaggatgtctacgtgacacaggcgctctgg

SEQ ID NO: 60 - DNA, 35 bp, Artificial Sequence
  oLMTB6156
cgcacagggtgacgaggaaagcagtatcgaaacag

SEQ ID NO: 61 - DNA, 35 bp, Artificial Sequence
  oLMTB6157
cgaccgcgatatctgctttccattctgcagttctc

SEQ ID NO: 62 - DNA, 35 bp, Artificial Sequence
  oLMTB6158
ctttacacaggcggtcacgtgagtgtccatgagag

SEQ ID NO: 63 - DNA, 20 bp, Artificial Sequence
  oLMTB7163
agcacatgtttcggcaggtc

SEQ ID NO: 64 - DNA, 752 bp, Artificial Sequence
  IrA
tcgagggaggaggaggaggcgcgtagcattgcgtgcgggttatgtgtgcgtgcgtgtgtgtgtgcggtgcgcgcctttcctcttttttttctccctctcgtcggttttttttttctgaggagacggggcgaagacgcgagcggggggcggcgtttgtgtgtgtgtgtgcgcgtgtcgggggcagcggtgttggcggaacggccaacgccctgccccctccccgccctgcgacgtttctgcgcacccgttctctccttcctgcgtgcgtgtctgcgcgcatgcacatctgtccgcgtgtgccgcagcgctggtatttttgtgagggcagagccctgcctccccgcctctctgccgttggcaggtgaagcgaaaacgaagcgagagggcagtctgcatgtgtgtgcgagggcatgcggagcccccctccccccgccccctgccgtgctgcaccgctattgtggcgtcttctctcgttgtgcgcaagtgtggctgcaccacggccgcctcatgtgcgtgtgtgcgcatgtacacacacacacacacacacacacacacacgggcaggcgcacgctcctctctcttcagggagcgccgccccgctggtgtcattggacgagcatccgccgcgcatctcttcacccctcacccctcatccctctcccctctccccgcacacacacgcagtccttcgctttcactcttcgaacaaacacctcaaccatcttatcacctttctctcttccttgtcaacc

SEQ ID NO: 65 - DNA, 1466 bp, Artificial Sequence
  IrB
gagacaaacgtggcggatgtgatgttttcagtttacttcgcctcttttcgttttcctttcaggcgacttcccttttgagttttcgtgtatgcaattgttgctgttctactgtgcagttgtcaccagcgccgcttttgggcttgtggcgtcggtgattctgcctacgtgattcttctccacgttaaccacacgtgttattgcccttcgcttttgcgtgcgcggtctgggcagccactaggtataggggtgtggtggagtgcacccgtgacggtgacatcccttcgacccgcgtctgctgcctcagacgttcgtggagagctgacatgtcgacatccctttggtgtgagcatttgtgagcgtgtgggtgtttagtgtttttgttaccggttttgttgcgcttgtgtgctctagtagtgtttgtgcgcgtgcgtggggcactatgaagcaagctgcggtagatgcgctgcgtggggtggtaggctgcaggactacaaccattaagattcctctctctctccttggctcgctctacattgaccctctgcggtggtctgcttctctacaatcgatatgcccgacacctcccgttgtgtgttcgttctcctttatcactaggccattgcattcggccctgttgatgtggctacggtcttagacacgcacaaatggtttgcattatttatcggccatggtgtgtgtcacactcgcttgattgattttgttctgatgtgcagcatgaaatgtcgggagaataaaacatagtgccttcatcataggatgacggatgcttgaatccgtctttgtcttctgaacaactctctgcagagggcgcgggtggctgacttctctcccccttcgtatggcgaaaggatggctttggcgtccttccgggcttcgcgcgcataggggagcagaatatgtgctgcaaagaagacgcctggcggctgcgtgcgtgcgtacgtgtgagtgtgtgtgtgtgtgagggctacgctgccggcaccactactcgtgcctatcttcaccaccttctcgttctcctccgtcttctcttttgcctggtgagcatttgtgttcaccatacctcaacgcgcttcgcatagctgcccaacctcctactactctgtttggctaatctcagctcgttagtttctctcgttaatcataacgagtttgcccctcccccccattgtgtgtgtgtgtcttgtaaaaaaaaaaaaaaaacattatcttctacctttccgcgcctcacatccgcatctttcgtgtgctgcccactcaccatcaccggcctccttcgttggcagagcaacatttgttcatgagcagctctccgtactgtgtgtgtgcccactagccggtgcagagtaggagccgcgcttttgttgttgtacgtatcttttgacgtgggtgtgcgtgcaagcaaggatctacgcgcaacaagtagcaggcaagcggatctgttcgcc

SEQ ID NO: 66 - DNA, 1339 bp, Artificial Sequence
  IrC
cctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagcc

SEQ ID NO: 67 - DNA, 2141 bp, Artificial Sequence
  IrD
ggagactgagctttagcgagggaacccgcatggcatacgttgccataacaagtgaccatctactctccttaaagtcatgggggtgctgctgcttggccggtgctgatcactcttgttgaggttccttcaggtgcggggactctctttggcgccttccctgcttgccgtgctctctcgacttgttctaattcccacgtgtgctctcttccgctttcgttgtagtggtgtacgctgcggttgagcttgttgtgcttgcgctacatttctcttcgaaggcggaggcaggcgcgcctgcgcagtgccgtgacgagagccactgccgtgtcgagctgcgagcaagagcagttaaggcaaaagggtaggtgagaaagatgactctgtgcggtgctctcttgtccatgcctgtccgttgttgtctcccctgtctctcccttttttcggcttgagtgacgttttgctgcctttgtacgttgttgtagtgtccttactgctctcgattgccgtcacgttgatgcccctatgtgtctccttttcttgcctcgcacattgcggatgtgctcccttctccgcccccttttttttttttttgccacagccggtgctgccttgttgcgagagcatgcgcatttggaacaaatggcacatagtcgtagcatctgcgctctggcctcggcgcctctctacacctttgctcaccgtgcatcacgccatctacaccatgttctcttcgtgttctgccactcttttaaatgctttgccttcccttggaatcccatgctcagccctcccctgcttctcacggtgcctgtggctctcggctgcgctctcctgtcgcctgttcttcttcttccgtccctgtggatgctgccgatttcccgtctgcccccgtctttcgtttgccgcctcccccttctgtgacgaatgccgtctctgtatcccggacgctccctcacgccaacccactcctcttttgcgttcttgcgtgtgcgtcgggcttctctccctccccctccccctccccctcccctgcctaccccatcaccgatgggtgtgtgggagagaggtggcaggggaagagggagtgcagataatgtgagacagaattgaaatatctgctctccgacacacagggagtaaatgcattcaacagggatggtaaggacacgcactggcgtgacatggagaaaaaataatggagtaatgcatgcagggctgaactcggcacagaggtacgcacccgtgggcaccctcttctctacggccctacctctttgtctccaatcgttttgtccccgtatgtcattattattgctcacctcgcggcattcttgatgtagccgcctcttgacatgtatagtgttgttcattagtatccaccgcaagaaaagaaatcctgcataccaccaatcgcgcgcactggacgttgccgaaagcagtcagtgggcaccttggacgttgccgccggtgtggaagtggccgcgtcgcaagcaggcctccatgacgttgactgcacgtccctcccggaaaggggatggctttggtgccatttaggacacaaatggagcttcttgtcgacccttgcttcgaggaatgaggctgcgtgtatgtgtcttggtgacccctttgggctgtgcagcttgtggcgtgtgcgcaccggcgtgtgccaacgcccaggtactgtgcgcacgttcgtatctccatacgctagctgaccgagacgcatgccctccgccaccctcagtggcgcgcaccttctctcgtttgagctctttatgctctcgtgaatggcacacaacatcccgtgactatcacgatgatccttctcaagccacaccgcttgccttttctacagctctgcgttctctggcccatcctcctcttgtttgctttccctctttgcacatccgtgtgcgcgtccttgttcttctcttctgcgcacactattctgcgcccgcgacccgcgcttcgactgctgtcgggtcatgccttgtgctgcgcgttcagctcttcattgcccctcggccttgtacatagcggctctccgtcatcgacgttttcctctctcttcagctctatacactccctcccttgtcaacacactacactgtgtctccccctttcatctctcctcccctgtcaca

SEQ ID NO: 68 - DNA, 606 bp, Artificial Sequence
  IrE
ttagcgctccgtagctcgctgcgtatgagaggtactgagctccaatgcatcacacggcgtacggcaacacacactatcttttcagtttatttttttaattatccctccaaaaagaagcaactgacacttcaaaatattcccaacaaggagcgtgaggtcagtgaccagtctcggacttcacaccgcgcatgtagaagcacgcggcttgcgcgccaggcttcttttggcaaaccacgctgcacagaatgtctgtgtacagcagccaggctgtgatcgatctattatgctcgcccctcgctcctccggcattctcgagtccatgtcgagcttgtctggctccgtgcacatgcaagcgtttgtgcgcgcctctaatgtaaccacacgtcaaaacattgtgtgtcttccgaagtgggagacaccggggccaccaactccggtggtttacagcctcctccctcaaccaacgctgccgattgtaccacctttcattgcgtctttgtgcccctccctatcttcatgtttccactgcgcttcgtttccgaatactattttcgtgtactgtttcatcactttctcacaacagctcttttttttcacccgcagaag

SEQ ID NO: 69 - DNA, 1579 bp, Artificial Sequence
  PolB
gcgtggggatggatcgcgagggacgcggggtttgagggccgtgggtggtgtggagagtgtggttgattattgtatggtggtgagggtggaaggtgtggcggggatggtggtgcggtggtgtcggaaggggtgtgtgagagggcgcgggtccttgagggagggtgggtgtgttgttgttttgcgggtgttatccggggcttgggtgttggtgtgattggtgactatgtaggggtgaagggtgagtggagggggtcgccagaggcgttccgttctacgaagcttcattcctatgtccgactccgaagcatgcctgcagttctgctggctatgtgggcgtgtctgggcaacgactgaattgagaaggggagtcgaaacggtgcgtggatgctgtgtttgtgctacacacaagcaaaggcaacaacacaagcgcatcgagccagacgaaccaacccaatattcacacaactgtacgtggccgcgcgctgtatctccgatgggatgatgcgtgtgcgtgtgccaccaccacgtactagtttccagccttactgcttgtataccttgtcttttgcgttgtgcttgcgcgtgctgtgtacctctgctcgtgcgttccgtatcccgggacctgcgggcggtgggtgccacacaacccgtcacattcaacatcactcatacatctcaccgatgtgtgcgtgtgcttgctgtgtgcgtgtgttgtgtggcgtcaaacctgtttgaaaacacacccctagcactattcgaccgcgaaagcgcccccccaaaggggccggtgtgcaatgcgagctacatgtatgtgtagagagcgctgcgccgaactagtcgtgcgtgctgaacatgttttgtgtgtgctgccgtgtctacacgtttgcagcggaaactcggttgaaccagaaacagaacttgattgttgctgcatttcgaggaatttcagccaaacaagaggtcaacaaccaagccgcgtgtacacatatacacacaccgcgtgtatgtatatatgcgtttgttttgttaccacaaatactgagttgtctgatgtgagcttctgctacagacgcaattcaggaaatacaacaaaatacaacacttgatcatcaatgcgcaatgtgcgcgtgttgtgtgtgtgtgtgcgagcgcacacacacatgcacacgactcacgttgtcacacaattgagagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacc

SEQ ID NO: 70 - DNA, 387 bp, Artificial Sequence
  5UTR
agtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacc

SEQ ID NO: 71 - DNA, 1297 bp, Artificial Sequence
  PolA
gcgtggggatggatcgcgagggacgcggggtttgagggccgtgggtggtgtggagagtgtggttgattattgtatggtggtgagggtggaaggtgtggcggggatggtggtgcggtggtgtcggaaggggtgtgtgagagggcgcgggtccttgagggagggtgggtgtgttgttgttttgcgggtgttatccggggcttgggtgttggtgtgattggtgactatgtaggggtgaagggtgagtggagggggtcgccagaggcgttccgttctacgaagcttcattcctatgtccgactccgaagcatgcctgcagttctgctggctatgtgggcgtgtctgggcaacgactgaattgagaaggggagtcgaaacggtgcgtggatgctgtgtttgtgctacacacaagcaaaggcaacaacacaagcgcatcgagccagacgaaccaacccaatattcacacaactgtacgtggccgcgcgctgtatctccgatgggatgatgcgtgtgcgtgtgccaccaccacgtactagtttccagccttactgcttgtataccttgtcttttgcgttgtgcttgcgcgtgctgtgtacctctgctcgtgcgttccgtatcccgggacctgcgggcggtgggtgccacacaacccgtcacattcaacatcactcatacatctcaccgatgtgtgcgtgtgcttgctgtgtgcgtgtgttgtgtggcgtcaaacctgtttgaaaacacacccctagcactattcgaccgcgaaagcgcccccccaaaggggccggtgtgcaatgcgagctacatgtatgtgtagagagcgctgcgccgaactagtcgtgcgtgctgaacatgttttgtgtgtgctgccgtgtctacacgtttgcagcggaaactcggttgaaccagaaacagaacttgattgttgctgcatttcgaggaatttcagccaaacaagaggtcaacaaccaagccgcgtgtacacatatacacacaccgcgtgtatgtatatatgcgtttgttttgttaccacaaatactgagttgtctgatgtgagcttctgctacagacgcaattcaggaaatacaacaaaatacaacacttgatcatcaatgcgcaatgtgcgcgtgttgtgtgtgtgtgtgcgagcgcacacacacatgcacacgactcacgttgtcacacaattgagagctctctcttctccttcccctctctctcctctctcctctctccagagctctctcttctccttcccctctctctcctctctcctctctccagagctcgagccacc

SEQ ID NO: 72 - DNA, 623 bp, Artificial Sequence
  UtrA
ctagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaa

SEQ ID NO: 73 - DNA, 955 bp, Artificial Sequence
  IrLmA
tgaactgcctgtcgcaacgaccacggccctctcgctttcccttggttggttcgtcaaacggctgaaccggcttctcttcctctgtcgctccttgtcctcatttctgtttcacacgacatacttgtctattatgtcgctgcctgtatgtgtgtgtgtgtgtgctgcaatgacgggtagggggctgaggcggcaaggtaagcaggggcgccgaggcacgggtagaggccaaaggcaggcgtcggcgatgatggaccttcctcgactttcttcgttgtggtcttatctttgctcgtttcaattcttgttttcatttctcgtcgtctgaaaagaaaggcaaaaaaaaacaaagaaggggcgcagaagagcgggatcgcgacgtgcgtacacgtatcgaggtcgcttcccttttttgcgaagtcttttcgacctctcgtacacatctttcgtgggctgttgtgcaccatgttcagcgcgcgacgtcgagctgtgctcgcttcctgcaatgacttcccgcccttcgtctttgtcttccactggaagagtgtggcacttcactcgccagtgatgaggggaagggggagcggaccaacaccgtcttttttatagcgataaggaggtgaggaggtggtctgtgtggcgttcctcgtgatgataggcttcatggtcgacttacttaccgcgtgaggagcagcatatccatccacctccaagttcctcgaagaggtcaggaaacgccacttctcatgccccgccagtctcttgtgtaaccttcgtccctcttattcttcatctcactcatccgtgcctcgttgaccacttcaccgtaacccgctccctccctttcaatctctcctgccccccccccccccacacacacactatcgctcactcgcgcccctttgttcgtgtttccctccctatcatatgcgtgcgcattccataaagtgttgcaatc

SEQ ID NO: 74 - DNA, 346 bp, Artificial Sequence
  IrLmB
cgagcgcgttgcctctgcgctggtgaacgtgcctgcgcacttacatctcagccgtgctttctgggaagaccttctgcgacgcggggcgctgtgctggtacagatggaaagatgtgcgccatcacggatgcatccttgcatggtgcgtgctcacgtgctcaccacagtttgtgtgtgtgtgtgtgtgagtgtgagtgtgagtgagagagagagtgtgtttcggcgcacctcccatccaacagtggcgtgaacggctttctctgtatgcgccctttcgttttaactctttctttttccgcctttgttttttgtgatttttgatgaactcaaacacaaaatgaacatcc

SEQ ID NO: 75 - DNA, 813 bp, Artificial Sequence
  IrLmJ
ttcctttcacctatacacgtggttcatatattatcggctttttacctgagagagcaaagaaagcttattagcacggaaaaacgtaatgtgctgataggggaaagaaacaaaaacaaccgcagccgagacattttgtttgtgttggaggaagtagaggaggcccatcggtgtctagaagacaataccgcagtgtgagacagtgacagaggtggcagaggagaggtagggggaagctcaaatgagtgctgtatcatgtatgcatgtctctctggctgcttctcagcttttcgttccggcttccactggactgtggccctgctccaaaccttcgacgtgggatgattcgatgactctttcttttatcagtgactgataccgatactgtgctgcagagaatcgagaaaaaaagcggaaaaggcggcagggcctcgatggcaaatcgtttagttgtgtgtgtcagtgatgcctctctaggtggcggagtggggctgcacgtgatggacgacgacgtagcgcaatacgcgccttcagtcgacagatcgaacaagcaccgtgctggtttcagtatccctgcgcactctcctggttatgggcgccttgaatgcgagcctttgtttgagctccacttgctgctcatcaaatggccacacttccgacctcccttgctctttttttttgcacttttgtggcacctgtgtccttgctgtcggtcctttccaacttcagcacacggagaaaccaccctgactgtagcaatcacgatccagtggggacaaaggagacgaggtgtcgagtgccatttcgacgatcgga

SEQ ID NO: 76 - DNA, 919 bp, Artificial Sequence
  IrLmK
ggtagactcgtgccgcgcgctgatgatgtaggtgcacgcgtgcgtgtgctgcagcggagccgccgccaccgcgactgtgtgtgtgtgcgcgcgtgacgaccggctcgaggaaggaggagcgcgcgtgtgcgtgcgatgcgcctcctctttttttttcgccctcgtcggtttttttttttctgagaggacggcggcggcggatggcggggcggcggcgctgacggagcggccacgctctgcacctccccgccctccgccgtctctccgttcgccgtcctctccttcctcgtgcgtgcgtctgccgcgcatgcacacgcgcgcgcgttgccgtagcgctgtgtatctgtggaggagggccttgtctctccctccccgtcgctgagagatgaaggggcaaaaagagagagcagtgcgcatgtgtgcctccgctccctggagctccccacgagccccctgcgccacgcacctgcgaacctgcacagcggcccacctgcccgcacacgtgagcagaaatgggtgtgtggagcgggtgatgtcggcgcgcacacgcgcgcgcgctgaccactccgacgtgaaaacacggaagagcgaggctggcaaggcagggcaggaacctgatcacgtgcgcgcgcacaaacggaatgagcagctcctgaagaggagatggggctcatgcacgcagacacgcacgtgcacactcctccgtcttcacggagcgcggccctgctgctgctgccatgtgccggacgtctgccacgcgtctcttccccacaccttgctcttcccccccccccttccctcccggcgaacacaaaacacgcgcacgcccaccgaaacaacaacgcgcagctcttcgctctcgttcttcgaacaaacacctttaaaccgccttccaacccctctttcttctttttcagcc

SEQ ID NO: 77 - protein, 1136 aa, Artificial Sequence
  OGNT-1
MCCLLRSVHRCSVVAFCLTSPACVCVRRTSAALRRTPPSSAAAAPALPWRRPRAHMRTELSASSLALFLCAQHDADMRVIPHRHRQKNSREDVRTHTHTHTHTHTHTHGLSVTSLHTGARATAVGRAPRTRDALMDTHVTACVKRVPSPAPFRDGLDAVATAGAAVVGDAALCMDAEVGSGLDERGRGPAGFTPASVAFAKEGNGRLASLAQPSHSSNYRGPSTVALRTAAMGHDDARTHVTHTTPALSSSATVHSRGSVRPLKHWMCCASRVHHVLRSLGILNDDADPANMSRILACSCATIGALLVLLIISFAALVVLLVVVVPDAQHRLSRTVSPLLDLNSKRNDRAAGGGRGGDDTASGLSVFDLQIRRLLASEGLEGFLRKAHRAADLRRRVQRNATLLAALRRANATRGKGAGDDVDWASLAQTLPELEHLSFLLAEVCAHVRAVQEHDPVMGLVKLSDFLLNVKGRKAALEKAAERARSLAANATSPAAAASDIGDAVARWNAALKESLAGRSEAARLRAQLRGFIGVSPWETERLTEQPFDDLALLQYRHAWAQSEVLPILRGRLGRAGARAAEEDPNAAVLRNNAVRHPPQNRSAHARSARLSPQEVAERIAMKADLYEVASIFNHVYYYPLRRYSALRPYGGSSVADTDAWYTAITAVVQTRFGVPITSNAAQTTETAAAALPLLQRDSPLSTLALQRLGLERAEEVARLHAEDRPLMPQALHSDAAESTHSIFVSLASYRDMECAPTLMSLFRTARNPHRLYVGVAQQNRAGDAPCLVPEMYTPYLCPSEGVPDSPRERGARARTLYGEGVDFMKSANVPEARSFDGGVCFLAEQVRLREIDARQAKGPTYGRYMAMLLYRGETLALVLDSHNRFRPMWDVLSATMLMRMEDPKAVLSHYPESYQGEQVDLQPYRTTTSYLCRANFLNNFGYLRLEAIVIESASDFAKNNVYNDPYVRVQSTDIDPATNHRLPQPWVAGGFLVSFGRIFRDVPFDPHLPYVFDGEEVLYSMRLWTHGYNIYSPARGACFHIYTRSSAPKVWAESPQWYSMQARVHERIQFLVQAHLLNKEDVMVPANSTSSFVIMDSSRYGMGKQRTVAQWYDYAGVDPVRYTLDGRWCGKSKRD

SEQ ID NO: 78 - protein, 1136 aa, Artificial Sequence
  OGNT-L
MRSRLLPSRRPRAARWARCTVFCLGFFIGAITLCGVVAWRIMSDMSEDVKGRRTLTQHPSPGKPAVPRVTDAGADDDAGLLRSSGGAAPYTESLEELVLLLRIYAEETGVRVTDTSYALPEGVSAGAGLMDGDANSQRGAETNGADLHLPGMALLRGRHGNGGPTGDHLSATWVLEDPETIRTEQEMYVERYLAPTQADVELTPLRVISSYYNTQGSRSLHRMAAETEKAMNDDGYATYIQRSSTFYDVSHAARRGYGQEGSIFVAVPFTLTDITPQMVGIIRRRASAVPTSSKTQKPTSSNSPLKERDNSVTDDGFHELRLTAARCAMTVESLFRQAHRGVAVTVGTLDVVTASGISSAVDLDFSKPSDVLFPLKPEDRASLGARRRRYTRITCEPPDFASGWDDASYGFRWKDNLRRRRVVVPLTQLEGLSATPTDPLRGEDAAATLERRFPLQYMGRYATLQLYRGESYVFFLRTGALVLPNWDLMLRLLYLRTPARDRAVLSSRPTPRVAWIALAASVAKMWDTEPFLRLSLTASWHRNGKGATDRDGEGAATAPPPDQVGQRLLAALPADVASWLSAAREEAELVLWLVTPSWLWPTMAETLADWRQLTASSDAQPPPGATASTLRLLFASDAVNGVLGDAASTLMTADLDTVQTTPVKRSDAAAASLHGQRVVSLRGGTNPTTNSTPQAVVAASLTPSEVYELLFLAEKRPPTPEQPIVQVPSSEPTLHRVPSQDLGPSVEPLCGEATSEAPYYSAADKALLKRSFEYCWLKEHRKVLRQQLHRLLHSTKATTVLKTTQATKVPAAGARGAKGGREGGPVVAEVAPRSSVCLADMRYLAPMEATLLTGADEGTSDSGPSAHHEEHAADQPSLRQENAWLTSAANVGKVHGVATSLVSKAARGTKERQGGSPQSPKDAASTPPEPTPYVLQSAASLDLLFGPAEAFFEFDTAHRLRTRARSLSEQLEERRLRREGLTATAAHAQVPEAVELDTSLQFMDGDLEDVYVTQALWTRGWNIFGTTEPVAVGTGEEEFSRSASAATTAPTSSSVAEDSVPAELRDARTFTHDKFWALLMAHRDAGTPLGATETRQQASAPRESSLLLYPLRRTMKEWELFAGMPLTTLRDALHPT

SEQ ID NO: 79 - protein, 638 aa, Artificial Sequence
  OGNT-2
MLDHGQMPSLLKRPLRMPRRRLSARRRQALKVFIVILCLCAFLFIFFFSARLPGILHERITPSEKPWLTRAGNSTLFEKVVHNRIPGTAWRDAHLNTIISLAKSGDVVHLTPTKHVRHRRASGSNSSTFQKWESLYRPSDRYHIPAWATPEDRDTLQHASIFTSLASFRDHECALTLRNLFDMAVAPHRLYVGVSEERNLSDESCLSSIGVEDLASGETRRVLYGAEAPDTLGVEVRSLTWAAVAGSRQLLDVDQEPRVFTGSAAESGAQPTGVFVHPSHAMERVTCIAGELETTRDRLLLAEDDAKESTDGRSVFRRGRGGPQQQPSHALAGCRVTTRVTYPTSARGPTFGRYITSLFFFDQDYYMVVDSHTRFSVDWDMKLITRVFQLPTRGVLSHYPNGYREGHDREEFDKTSVMLMCTAQVLSNGMPKLGARWANVSPRPVLQGFAAAGFMFGDAQFMLDTPFDPFLPYIFDGEEVLYSARMWTAGWDLYGPGQPDVFHHYGRMHTPKYFEVLTPTKAARRELSEKRALHLLRRAHPWIEELVRRGYVSSDGQSTLKPLPPEEAPETRLIVTDEVAADTQEIRVWATYYGMGTERPVAAYWKHTELSDEFVKAKDDEQRWMGGTGLCEKSDVLA

SEQ ID NO: 80 - DNA, 16300 bp, Artificial Sequence
  OGNT-1/L region
tgcagagagagagagagagagagcgaggggggggagcacgactaccttcgctgcactccagcagcaccacagcaggcgagtgtagcctttccagctcgctcgcagaatgtgaaagccgcaccacgcactccttttccagggatgtcagcgcattgaccgcccccgcccgttcaaacttctctgcacatcatagtcgccaccttgtgcggcaccccagccgcagcagcggcaccgccctcttcgctggtttgagcaggcaccacacaacccgtggtgcacacaacgcagaggcgatcggcagctctcacatgaataggtgaccactccagcccacgtgtcattagcctcatcgcaggtgagaacgtacggtgttgccactcgcgcctccggctcacgtccggttcgacgacgagaaacaggaatgtaggaagcaggcacacccgcgtgaggcggcgaacgagcgtggcacagccgtggtcacgccgaagcacagaggacgccgttcggtgagtgagacacttgtttcacatgcctgctcgttcggcttccgcccacccctccctccctccctcccccctcccctgccgtacggcacacgtgcggccgcctccctaccccaccccctagccacagacacacacgcacatacacgggggcctagaggaaggaaagagttgaaaacagccagagtctcggaggtgtctagtcggctggagcggtggaaaagcgccaaaggaggaagaaccccacgaacgtttgtcggcttggctgcacgcagcgaggaggaggaggaggaggaggaggaggggggcggggggcatcgcacgcgtatgccaggcgcctcgcttggcagccgcgcacgcatcccccccccccactgtcacgcttcatcatcgcgcgcggcccccatcatcagcacgccagcgcgcaaaacgcttacgctctgaataccgggggggatccgatttctaaaaggtcacattgtacacggcgacgccgtcctgcacagcgaggatcttcggctttgcatcccccgcgcgtgcgccgtcaggcacccaccgcacaggattcaggttgtcccagccgggccccagcgaagcgttgatgttagcgcgtatccactttgccccacgctcctgcgccgccgcctccgccgccgccgcctcggctggcgtggtgccgcctctcagctggtgctcctccacaaagtagtggctgtgcaagtggtacatgtccgcccgggtgcagcggtgcagcaccacagatgcccacgtcacaacactgctgacgtcgcgccgcagttcgtgaaagcgggacatggtttcctcagcatgcgtgatgcgctcattcgggcacagctgcgcggcacgcgcgcgtcggtcgcgcagcacgcctgccagaaggaggtcctcatcgtccattgcaatgtccctgtaaatgccggcaaagatggggttgaagtcgtacattgaaagcaacgcaacgtcccgcagtccgttggtgccgtaggcgtcctgtggctcctccaacacgatgcgcgccaccttgcgagtgatccagtggtgcctccgtgaaaaaagcggcccgctctgcagaccccagtccacgcactcgctctccggtgatcgcggcaggcgctgcgcagcggcggcggccagtggtccaccgatgcgcaccgtatcagcagcagcggtgactgtatccgtgaaaggtggtgcgttgccggcgttgctcatcaagtttgcgtcgaggtcgcggctctgccgaccactcagcacgtaggtaaagtcgctcagcatctgcggcaccttgatgtagacgtcatcgtagctcttgccaataaacgccacgtctgggaaggcgtggtaggcatactctagccacagcaccgtcttctgcgacatgatcaccggtgccgccatcgcccagcggctgtcgttcacctctcgcctcgctgtcccatttcgatcactcagcatctcgagccacagtatgtcgcggtgctgaagcgcctcggcccacaggccactcgacgcctcgcacaagaagcgcgctgccgcggtgaacgcaggaataataggaagtcgaaggtactcggccaccgccgcaagcggcggtcgcgggtggtcggcggtgctgcgcaccgttacggagatcatgtgatcacatggagagctcgtcagatccgatgtgcgccacttcggccggagagtcatgcgtcgctgtcggtacgacaggttcacaggtgctgcccctgcactcgacggcggcgcggcaagtgcgcggtaaaagttggtggcgtccgcgaactcttgcaccgtcgggcgatgaaacgaggcggtcgcctcgggccccgtgtcctcgtcctggccgacccacgtcgggtccggcgctgccgcgcgctcttccgcggccaagaggtacagggggagaagacgtccatgaaatttgttctcacggcgggcaacagcggtgtactgaaaccacgtgcgacgctgcccgtctcgcagcgcggcacgggagacggtgtccgtggagtggatgcccatgaccgcgacgtagggcggcggccttgcagggcgggtcgctgaagaaatgttggcgtactgcagccagtgccagtgaggcagctcggcggccacgtcgacgtcgtcggtcacgctacgcatcgccagcaacatggggccaatctttcctagcggtgcgccaatgttggcgaacacggcgaacacgccgcctttggccttgaggagatcctccaaagcccacgtcggtaaaggcgccgctgccccatcgcgcgcgcgagcctctgtggcagcgccgccaccgactccccaagcgcctgatcgttctcccctctgcctctgttcttgcggtaaagcctgcaactcggcttgttggcctgtgttgcactcacactgaattttccccagcccattcacggcccgctgcagcgcgattgcatacgtgtcactgtcgaggcaatcttcgcaggttgccggcaccacccgcagcgtccacgatggcaagtggatccacttgaccttccgcgagtacttgagttgcatgcgccggggcgcatcctcatgctggacaagaatcgaccgcgtgccgttccagccaggcacgtggggtcgacgcactaggcgcatggcacaagtacagatgcaaagcacgacgagtgccacgcaggcagcgcgggcgacgaggagtgcacagggaccaaacttgcatcgctgccgttggccagccctcgcctccggcaccgtctgactcaggcatcgccgcagccaccggccaccggactcagcagtggcacccatccgcagccacagccgcacgcatcgcccccgccagcaggcgcacgtccgagagtacaagttcgtgcctctgagagattctggagaggcaactgaggtggcgaacagcacggattccagaagccccgggataaggtgcgcgcacttctcttttacgcctggcttgttgcggcagtggggcccggcactgcactcgacagcggcagccccacgcatcatgaggaggtcgccacgcagggggccagggtctccgtgagtcttcaacgcctgccccgaggtaggtgtgtgccagacgggcgttatcttcctcgacacgagcatctgaagcgactgtggtgaggcttggaatggtggtatcgagttcactgcgcatgcgcgtacatccttcgagccgcgctgggctgagtcctgcgccgaagcacccttctgcccgtcctggtccgcctcttcagtgtatatgacgctttccgccattgtatggtccgtcagtgcaccgctagcactgttggcataacactggtccgcggtggtgttgccgccttgttcactgccgacgtcgtatcgtcctcgcacccgagctccgctgctgcaaagggcctgcggaaggctctccccgtccagcattgccgactcttgtgcggcgtggactgagaacgcaagcgtggcagagaagtagaggcaagagcgaagccgcggatgcgctggtgcgggcgcatacccacacgcacctacgccagaagcgctgcgccgggagacaacgaagaaaggaaggggtggcgatactacagcatgcacgcgaagcccaacagtagcaagcggtgcgggagcaggagcggaaggtctaagaggatcccaaacaacgatgcgttgatggaggggtgtggcgatgaggatgcgatgcgatcacgcacctcggcttcaactgccaatgatagatgtgtgtgtgtgtgtgtatgtgtgtgtgtgtgtgtgtgtgtatatgtgtgtgtgtgtgtgtatatgtgtagatgcccgtatcctctgggccgcacgcacacgtgcaggcagcgtcctccgtgacccaggcgctgctctgccaaagcgcagacgcgtgcactcgcccagctgaatcaagagagcgtgcggagaagcacaacaacgcgtgtataatgctgagctggtgcgcatagatgtcaaggtgaccatccatacggcgaagacgcgccactgcagggatgcgtcactgccgcggttctctcgcccaccgacctctccaccgttgcgcacgcgtgtgtgaacgcgcgtaaattcggcggctgctcagcggagcagagacgtggccgctgacggtgagtggtcgacgacctcgaaaaatagaggaggaggggggcgggcagccgagcaggaagacatgcaaacgcacgaaagcgggagtcacttcggcccgtcgctcagcatacacgtaggtgccgacaacacgcgagcaccgccgtcagcgcttccccctcgcggccacggagaagctgagaggcggaggggacacagcaggtgtgagttgtgtgcggcactgtcccccacaggagcgggtgtggcggcggcttggaaacaagatgtgtgtgtaagttcacgtatcttatgaaagaacctgtggagacccaaaaacgaatgtgcaggcggggtggagagggagggtaacagttttggcgagcagcgtagatgaggttagcgagcgatggcggaaacgccatgcggagacgacaggtcgagcgagacgcgcccacccgacactcatgtgttcaagtgcctcggggagacgcctctgtgttcaactttttttttttttggcgatagattttcattgtgccacaggggtcttacatcatgccaccatcagcgccattgccctgcaccacgatacgcaccttgaccggacaggcgtagtgagcaacgatggcaggcaaagcgccgcgggaaaacgtggcgcgagactggggagaagaccttccacagcgcagccacaacgatagccatcaaagacatgaggggcagtacacagccacgtgcgcgcatgtccacacaataccaccgtgcacacgcacagcttctctctcccccccccacctatacacacatactcacacagagagagagacagagacagagaggggaggagaggggcacagagagcgacgcacagggtgacgaggaaagcagtatcgaaacagtgaccagcaggaacgttcctgccggtgtccacttgtgcccgtgctccactacgggccggtcaaccaacggacacccgcaccgccccccacgccaagagtccaaccagccatcacctcgagagcctgctgccgcgcccgcacgccccacgccccagtggccggcatcccccccccccacacacacacgggaatcccctgagcgacacgcacgccacacaggaacacatgaaaaggtgagagaggaccaccgcagagggcggccatggggaggaagaagaagaggaggaggagggggaggaggaggacacgtgcgagcgcgccacctcggtcacatcatcattctccctctaatcgcgcttgctcttgccacaccagcgcccatccagggtgtacctcaccgggtctacgccggcgtagtcgtaccactgcgcgacggtgcgctgcttgcccatcccgtagcggctcgagtccattatgacgaaagagctcgtgctgttcgccggtaccatcacgtcttccttgttgaggaggtgcgcctgcaccaagaactgaatccgctcgtgcacgcgggcctgcatgctgtaccactgaggcgactcggcccacacctttggcgcggatgagcgagtgtatatatggaagcaggcgcctcgcgcgggggagtagatgttgtagccgtgcgtccagagccgcatcgagtagagcacctcctccccatcgaagacgtacggcaggtgcgggtcaaaggggacgtcgcggaagatgcggccaaaggagactaagaatccccccgccacccacggctgcggcagtcgatggttcgtggctggatcgatgtccgtcgactgaacgcgcacgtacgggtcgttatagacgttgttcttcgcgaaatccgatgcggactcgatcacgatagcctcgagtcgaaggtaaccaaagttgttcaagaaatttgcccggcagaggtacgatgtggtcgtgcggtacggctgcaagtcgacctgctcgccctggtagctctctgggtagtgcgacagcaccgccttcgggtcctccatgcgcatcagcatcgtggcgctcaggacgtcccacatggggcgaaatcggttatgtgagtccaacaccagcgccagggtctcgccacggtacagcagcatcgccatgtagcggccatatgtcggccccttcgcctgtcttgcgtcaatctcacgtaggcgcacctgctccgccaggaagcagacacccccatcaaagctacgggcttcaggcacgttggcgctcttcatgaagtccacgccttcgccgtacaacgtgcgcgcgcgtgcgccccgttcacgtggggagtccggcacaccttcggacgggcacaggtaaggggtgtacatctctggcacgagacacggcgcgtcgccagcacggttctgctgagcaactccgacgtacaagcggtgaggattgcgcgctgtacggaacagactcatcagcgtcggcgcacactccatgtcacggtagctcgccagactcacaaagatgctgtgcgtactttccgcggcgtccgagtgcagtgcctgcggcataagagggcgatcttcagcgtgcaggcgcgccacttcttctgcgcgctccagccccagccgctgcagtgcgagggtggagaggggagagtcgcgctgcagcagcggcagagccgctgctgcagtctcggtggtctgcgctgcgttcgaggtaattgggacgccgaaacgagtctgcacgaccgcggtgatggcggtgtaccacgcgtcggtgtcggcaaccgagcttccgccgtaggggcggagagcactgtagcgacgcagcgggtagtagtagacgtggttgaagatggacgcgacctcgtacaggtctgccttcatcgctatgcgttctgcgacctcttgcggacttaaccgcgctgagcgtgcatgtgcagacctgttctgtggtggatggcggacggcgttgttgcgcagcaccgcggcgtttgggtcctcctcggcggctcgcgcgccagcacgacccagccggccgcgcaggatcggcagcacctccgactgcgcccacgcgtgtcggtactgcagcagcgcgaggtcgtcaaagggctgctctgtcagccgctccgtctcccaaggagagacgccaatgaagccgcgcagctgcgcacgcaggcgagcggcctctgagcgccccgcaagcgactccttcagcgccgcattccacctcgccacagcatccccaatgtctgatgcagcagcagccggcgacgtcgcattggccgccaggctgcgcgcacgctctgcagccttctccagcgccgccttccgacctttcacgttgagcaagaaatcgctcagcttcacaagccccatcaccgggtcgtgttcttgcaccgcccgaacatgagcgcacacctccgctagcaggaaagagagatgctccagctccgggagcgtctgcgcaagacttgcccagtccacgtcgtcccccgcacccttgccgcgggtcgcattcgccctgcgcagtgccgccaagagcgtcgcgttgcgttggacacgccgacgcagatctgccgcgcggtgggccttacgcaagaacccttcgagaccctcactggctagcagacgtcgaatctggaggtcgaatactgagaggccagacgcggtatcatcaccgccgcggccgcccccggctgcgcggtcgttccttttactgttcaagtccagcagtggggagaccgtccgagaaagtcgatgctgggcgtcaggcaccacaacgaccagtagcaccaccagtgcagcgaagctgattatgagaagcacgagtaacgcgccaatagtggcgcacgagcacgcgagtatccgcgacatgttcgccggatcggcgtcgtcgtttagaatgcccaacgagcgcagcacgtgatgaacgcggctggcacaacacatccaatgtttcagcggtcgcacactgccgcggctgtgcactgttgccgatgacgataacgcgggggtcgtgtgggtcacgtgcgtccgcgcatcgtcatggcccatcgccgctgtcctcagcgccacggtggatgggcctcggtagttgctgctgtgcgacggttgagcgagactagcaagtctaccattaccctccttggcgaacgccacggaagccggcgtgaaaccagcagggccacgcccacgttcatcgagtccagaccccacttcggcatccatgcacagcgctgcgtcaccgacgactgcggcgccggctgtcgcgacagcgtcgaggccatcacggaacggcgccggtgagggcacccgctttacacaggcggtcacgtgagtgtccatgagagcgtcgcgcgtgcgaggagccctcccaactgcggtggcgcgagcgcctgtgtgcaatgaagtcacagaaagtccgtgtgtgtgtgtgtgtgtgtgtgtgtgtgtgtgtgtgtgtgtccgcacgtcttccctactgttcttctggcggtgccggtgagggatgacgcgcatgtcggcatcgtgttgggcgcagagaaagagggcaagcgaagaggcgctgagttcggtgcgcatgtgggcacgcggccgcctccatggcaaagcaggcgcagcagccgcagaggaagggggggtacgtcgaagggcggcgctggtgcggcgcacgcacacgcatgcgggtgaggtgaggcagaaggcaacgaccgagcaccgatgcacagaacgcagcaggcagcacatcccccgcccccgttatataacgtgaagtacccagtcaagagcggatacggggggggagcactgccacttgaatttgggtcaaggtggcacagtgctcctgttgctagtttgttctccgcacagtcttattaggaaacgagaaagcgtcaatatcatactccacatgtgttcgtgctccactaccgaccggccaaccaacggacacccgcaccgcccccccccacgccaagagtccaaccagccatcacctcgagagcctgctgccgcgcccgcgcgccccacgccccagtggccggcatcccccccccctcacggtggaggagggtgcggaggatgtcgcatcgaacagcagagataagtgaagcagcatgcgcaggtgttggcgggtgggtgagtccgcgcctacacggaatcgactccgtagacgccaagtgccacggcggcggcggagcacaacgcttggctgttgggggcgggggggggggggggggggtcaagacaccactgcgcaccatacatcaggagagctgaagcaccgggcgcgttgatgcaccttcgcgtgtgacgccgaggaggaggtccagatgatgcgtcggcgccgatgcgccaggcttaccagagaaagcagacgatcgatggcgtacgatgtttctgatgcacaacgcatgcgctggttgcgcgtgcgccgagatccaggtcgttgtgcaggaggtcctcgcaagttggggacgatatccctgcatgcgtcaggtcgggtgcagcgcatcacggagggttgtcagcggcatgccagcgaacagctcccactccttcatagttcggcgtaaggggtagagcaacagcgagctctcccgcggcgcagaggcctgctgccttgtctcggtggcgccaagcggcgtacccgcatcgcggtgggccatcagcaaagcccagaacttgtcgtgtgtgaaggtgcgcgcatcacgcagctcggctggcacgctatcctcggccacggaagaagatgtcggtgcggtcgtcgccgccgacgcggagcgggagaactcctcctcgccagtgcctacggccaccggctccgtggtcccaaaaatgttccacccccgcgtccagagcgcctgtgtcacgtagacatcctccagatcgccatccatgaactgcagagaggtatccagttcgacagcctcgggcacctgagcgtgcgcggccgtcgcggttagaccttcacgacggaggcggcgctcttcaagctgctccgagagactgcgcgctcgagtgcgcagccggtgcgccgtatcgaactcaaagaaggcctctgcaggaccgaaaagcagatccagcgatgccgctgactggagcacgtacggcgtcggctcagggggggtggacgcagcatccttgggtgactgcggcgaccccccttgtcgctccttggtgccacgagcggctttggagacaagcgaggtcgccacaccatgcaccttgcccacgttcgcggcggacgtaagccaggcattctcttgtcgcagcgagggctgatcggctgcgtgctcctcatggtgcgcactcggaccactgtccgacgtgccttcgtcggcgcccgtgagcaacgtcgcctccatcggcgcaaggtagcgcatgtccgccaagcacacactcgagcgaggcgccacctccgccaccacagggcccccctctctgccgcccttcgcaccccgcgcacctgcagcgggcaccttcgtggcctgggtcgtcttcagcactgttgttgccttggtggagtgcaggaggcggtgcagctgctgccgcaagactttccggtgctcctttaaccagcagtactcgaaggagcgcttcagcagcgccttatcagcagcagagtaatacggtgcctcggacgtcgcctccccgcagagtggctcgaccgacgggcccaaatcctgggacggtactcggtgtaacgttggttctgatgacggcacctgaacgatcggctgctctggcgttggcggccgcttctcagccaagaaaagaagctcgtatacctcagagggtgtgaggctggcagccacgaccgcctgtggcgtgctgttcgtcgtagggttggtgccaccgcgcaggctcacgacgcgttgcccatgcagggacgctgccgcggcatcggagcgctttacaggagtcgtctggacagtgtccaagtcagccgtcatcagagtcgacgctgcatcgccgagaacgccgttcacggcatcgctggcgaacagcaggcgcagtgtagaggccgtggcccctggtggcggctgtgcgtctgaagaagcggtgagctggcgccaatctgccagcgtctctgccatggtgggccacagccagctcggcgtcaccagccatagcacaagctccgcctcctcccgcgccgcgctcagccacgatgccacatccgcgggtagcgcggccaaaagacgctggcctacctggtcgggcggtggcgcggtggccgcaccttccccgtcgcggtcggtcgcgcccttgccgttgcgatgccacgatgctgtcaacgacagccgcaggaacggttccgtgtcccacatctttgcgacagaggccgccagtgcgatccatgccacgcgcggtgtcgggcggctactgagcaccgcgcgatcccgcgcaggggtgcgcaagtacagcagccgaagcatcaggtcccagtttgggagaaccagagcgccggtgcgcagaaagaatacgtacgactcaccccggtagagctgcagggtggcgtagcgccccatatattgcaggggaaagcgcctctccagtgtcgcggctgcgtcctcaccgcgtagcggatccgttggagtagcggataagccctctagctgtgtcaagggcaccaccacgcggcggcggcgcaggttgtctttccagcgaaatccgtagctggcgtcgtcccagccactggcaaagtctgggggctcgcaagtgatgcgggtgtagcgccgcctgcgcgcgcccaggctggcgcggtcttccggtttcagcgggaacagcacgtcggatggctttgagaaatcgaggtccaccgccgaggagatcccgctcgcggtgaccacatcaagcgtgccgaccgtcaccgcaacgccacggtgggcttggcggaaaagggactccaccgtcatagcgcagcgtgccgcggtgagtcgcagctcatgaaagccgtcgtcggtgacgctgttgtccctttccttcaacggcgagttcgacgaggttggcttctgggtcttcgacgacgtcggcacggctgacgcccggcgacggatgatgcccaccatttgtggcgtgatgtctgtgagcgtgaagggcacggctacgaaaatgctgccctcctggccgtatccacgacgagccgcgtgcgagacgtcgtaaaaggtcgacgaacgttgaatgtatgtcgcgtagccgtcatcgttcatcgccttctctgtctcggcagccatgcggtggaggctgcggcttccctgcgtgttgtagtacgacgagatcacgcgcagcggcgtgagctccacgtcggcctgcgtgggggctaggtagcgctccacgtacatctcctgctcggtcctaatcgtttccgggtcctcgagaacccaagtggcggagaggtgatcaccggtcgggcccccgttgccgtgccgaccacgcagcagcgccattcctggaaggtgcagatcagcaccgttggtttccgcgcccctctgcgagttcgcgtcaccgtccatgaggcctgcacctgcagacacgccctctggaagcgcataagacgtgtcggttacccggacaccagtttcttcggcgtagatacggagcagcaggaccagctcctctaagctttccgtgtatggagctgcccctccactgctgcgcaacaacccagcgtcgtcgtcagcgccagcgtcagtcacccgtggcaccgctggcttgcctggggaagggtgctgcgtcagcgttctgcggcccttcacgtcctcgctcatgtcactcatgatcctccacgcaacgacgccgcagagagtaatagcgccaatgaaaaagcccagacagaaaacggtgcagcgggcccagcgggcggcgcgaggccgccgactcggaagaagtcgtgaccgcatgacccacagtcctgcgaatgccggggaccgagggtgtccgatggacccgttcgctgtctgggcaggcctctgtggcgctgcctgacgcgtgcccgattacgcgcgcgcccacaggaggacagcaggcgaggcggattctgagcgcgcccgcgtgtgtgcgctcgagaggggggaaggaaagacacaaagaagtgtgtagagaactgcagaatggaaagcagatatcgcggtcgcgcagtcacgtgcgacaaaagtgcgcgcagctgccgtgttgttggtgctggtgctaatacgaaggggatgccagtcgcatcgctgcagaaggaacgttgaaagaaaagcaacacgatggaaggacgccacggcgacgcgtagcagcaaagctcagaaggacgcggcaagagcggaggtgctcgcgcgcatcggtgtacgaaaaagcaccatcactaccggcgattcgtgtgcgacgcagtggtgcagaggcgtccagcacgagagagaataagagaggccacgacggcgatgacaagccgcacattcaagcggccgctcacgcatgcccacgaccacgggcatccgtcatcgccgtcgccactgccacagaaacgcgtcagctcattagtggatggcctttccacgttgttcgcatcaacgcaacagtgtactacaccttcctcgatactggcaacaaggggaagggggtcagtatgcattacgagacacacacacacacacgcacgcgcgtgcgcaccggccgtcggctactgccttgcgcgtccctcatcgaacgctttacagacacaaatacgcggctgtaacagcacgcttgtccgtggcggcgctccgccccggaagccgcagttgcccctccccccgtgacgtccgacacgccctctccacctctcttcttcctcagacctgcgggcgcacccccctgccacgcatcggaaggcggaagcccagcagccacctaaacagctacggccacaccaccaagaacgtcgaaataaaaaaaaaataaaaaaataatacagcagtgacccacaacgtcgtccatgcgcaacagcgacgcgcgggtgtgtgtcacgcccaatttgcttccacctccctcgcatgagaagcgagcctgcgtgaggcaaccgtgtcacgctcccccttccccacgcccactaggcctggttaggtgtgtgtgtgtgtgtgtgtgtgtgtgtgttcaccgctaatgggaagcctcccccgcccctttttttcaggagcgcgtacgcaggcacgcactcggcggcgtccatcacgcaagaaacaccggccatcaaggtgaagcaacgaacaagggaaaggaaaatcgtgcacgacagagaccgagaaaagcaggaggaggaggacgtcgagccgacgccacgtgttccgggtacacacccccgcacgtcagcagcaagtgctgctgcgactgccctgcacattcgagttgacagcgtccgccccaccagcaccagcggtgccattcgaggctgcctgcatcgcggatggggttatcaagaagggtggccggactatgccaccaaattggccagcgctggtactgggcgctgcggcgccaccgccactcgcacccggtgcgccagcgccgccagtagacgacgttgccccgcgggcaccggcaccgccagccgtggaagccggtgctggtagtgccgcagcgacctgccgaaacatgtgcttgatgtttgtgccatgcttcgcgctcacctccatgaagagaacgttgcactctgacgccttcttggttgcctcctcggtgcttacctcgcgcagctccgatgcctgatccattttgttgcctacgagcatgacgaccacatcatcgccgctctcggcgcgcacctcgtcgatccacttgaaggccctgaagaatgtggggcgagaaccaatatcgtacacgaccacggtcgcggcactgtttctaatgtagctggggatcagcgagtggaagcgctcctgccccgccgtatcccacaagtgcagccgaacctcgcgatcatcttccaagtgaaccgttttcgagaagaaatcgatgccgatcgtcggctgatactgttggtcaaaagtgtcgtacatgaagcgggtaataatactcgtcttaccaacggactggtcaccgagaagcaccagcttgtgcttcgctatgagcggcgacgcggccgccacgccggtggccttgtccgaggcacgggtgccggctgcgtgcatgctgcgttctccctctctttatttttttttttcaagggcgatcaaagtggggcacactgctgtgaatccgttggcgcgcgcggcgtcgtcacctccttcagttgtgtttcgtttttctgcggtccgccccagcaacggtgaggcgcgcacgacgtcgcacacacgcacgcagaagcgtcgagacgggtgctggcggggtgacactgcagtgatgtatggacggcggagacgacggcgcgtcggcacaaggcgtaggaacggcagaagagtacgagtgaagggagacggggaaaatgccactccgtgtctagacgcatcgatgtgggcccgtgagcatacgagcgctggtgcgtgccggcgccgtaccagcgatgagctgaatcgcctgccttttgtcgacgagagaagtcaccgggagagggcgagagggcgacagcgctgcgtgcgtatgtgcgtgtgtgtgtgtgtgtgtgtgtgtgtgtgtggaggtgcgtgcttggtgacgtgcgtgatggcacctacgcggcataaactggcaagcggcgcagtcgatttaaaacgcaacgaggcgcagagcatcacagatgacggtgagtgggaatagaggggggggg

SEQ ID NO: 81 - DNA, 12200 bp, Artificial Sequence
  OGNT-2 region
gacacgtggaggatacaagcactgttactggcacacatcacccggcaccacccggtttctctgctcccttcacatacagcactgcccgcacgcatcacgcaccctcatgaggtgctgtacttcactattgtgtccccttcgatacagagccgtctatttttgaatgggaagcagcgaaagcgctgcggtgaggtaactcctctttcgcagtggcgcctcttaccacgtcatctgtggccgaacttgccgtggcgctactgagtgtgcaacagcatccccgctgctcccgttggatggcaaccttcatgcccgtctgcacttgtgcgtatatttgagctgctgctgttgccggcagtgcactgacgctcccgtcttactcgctgcggtctacacgtcctcttctgtgcttctcgcacaccgtcacgcaggctccgggaacacgatcgcggtagccccccccccccccccccccccccccccaaagtgaccgcagcctgtgtgcgaggacgagtatgcccgcgcgagcttcgtggtcggggcgagccgatgccggacgacaagtttgtgaaggctgggaggctccctagcatgggaatggaggtgattatgcgctgccgaacgtacagtagtccctccgactcctgtatgctgctcgtcctcggcttcggtggcacccttacgtcactgggtcgaagcagttcgtgacgacctcctcctccagggagacgtgtaccttgttcgctttgaccaccccgactcgggcgtgccggcccacgtggacggctctccaaccctatgcttctcctgcatggtactccaatcgcgccccctccccttcgcacaggctcgcaccctacacgctctacaacccagcgagcgatgcctgtggtttgctgacggtactcgaggtccgttgtatgcacaccttcaccacctccacgggtggcaggagcgtgcttggcagaaccctagaacatgctgatccggcgcttagcctcatagttggttattcactcagcagccgccttcgcgtggagccacggatatgtccgtgtgacgctggcgttgctctacaagtctgctagcatgcccatgagggacgtcgtggactacgctctgcgcagtggctgctgcttcagagagagaggggggggcgggcaactgcgtgctggaggagcaccgtgtgggcgggcttgccagggcttagcgtcatgcgatgcgctctcgacatgagtgggcagtgcagcgcgccccccaaaaaaaaatgaagggtgtgcactccgcctaccgaggcgtttctcagcactcatcgtacacgacagagaagtcctacggataccatgctacagcggcttgcgtgatgcgtgatgcacagcatactcatcctcacatgggcggtggtatctcgaggcaactctgccgtaaaatcgcggcagaggtcgacgtacaggcgctgcacacggtggagtaaatgcgccgttgtaggggggatggtctccgcggcgagcgcgacggatgcctccttccacgaccggagacacaaccagggcgtgaagacaaagggaagggggaggcaaagaagggaggtgccgcttgtttcacttattattattattggttgctgtgtgtcttcgcggcagtcaacaagaacttcacgtttctggagagggacgacgtggcagcctacatgcggtcgtgtgggtggcgttgatgctgttctttggctctagcggagtcggagggcgtggagagccaagcccctgcaatcgtggtgacacgtgggtggctgcggtggggtgggggtggggggtctggagaaagtggctgctcacgtcaccgattgtgctgtgcccccttcagcactgtgtgcttgcctgtggacgctgcccacaatctcttcgaatgcctcagtgcagatgactaccggcaccaaacgaaatagtgcgtaccagatatgttgcagagccactctctcccctcgtccgcacaccttcatgctcacctcccgcccgccatcgctgccctcgttggtctaggcctgttcccacccttattattattattagttttcgcacccttcctcctcctccaccatcgccaccaaccttacactccgtaggacgtacgcgaagatggaggtgactgagcgcatggaccacgagaggatgcgattgccttcctgcttcctttcgttgtgcttcatcgtttatattctttgaacacgtttcatgggccaccatttctttctgccccatgagttccctaacgaccccctcccctctcccccgctgcctgacgccctcgcggtcactcaacagcccacgcttctctgctgtggtgttgagtgacggtgtgcatgtgcgaggttgtgcgcctcgactgtatcatctccctcactccccttgcttcgttgtcttcctggtccaccatcaactttttctacgcgcacgtgcttctcgttcctctgccactctctgccttcctactctctgtgtcggtcggctccctctgtgcccaggccttgctttcaccttcgcctgtgcaggcgtactgcttcaggtgtatcgctgctctactccaacgaacgaacaaagaagatgcagcagtgggaggatacgaaggcagagagggagacggaggggagagggaggcgcagcgcgctccctgcagctggatgcgcgttgtcccgcatacgcaatcgttcttccgctttccgccgcctccgtctgctgctgtctttgatggcatgcgcgggactgctttgacggcgtcacctatttctgaatttgtcacacgtacaaatgtatatatatatatatatacatacatatacgtgcatgtgcactgatgacggtgggggttacccgccacgctcagctgcgagagcgtaaacctccgtaacaatgatactttacgcatagcaccactgcgcagcgcttccatgggccgcccccttcacctctcgcttcgttggcggacctgtgcgcgctcgccgtgcgtaacgaggggcgtctctctctttgcccgatgagtggtttgtgtctcggaagtacttgaaatggtgtatcccatgacacgtcttacgtcatgttcctccctccttcgtatgcgtacgactctcctccgcctccgcctccgcctccgcctccgcctccgcctccgccttctctgcgccggtttcctggaggatggagagctcttgctcatagattgaagaaagaccaggcaagccacggaaaactccgaacaaaagcggactcacgcggccgtctgcatttgacgtgcttgcatacatatacgcaccaaccttgtgcacgtcttgttgacatccgtaacacttgcctcattttttccgtgctgctcggatgcacactcctggtgtggggcgtagtcactattcgtctctcaccaacacacacacacacacacacacacacctgtacatctctctctctctccttttctgtgtgccccggcggacgtgcgtgcgtgtctaatcactgaaattcttcacattgcatagaacgtagcgtcaggacgcagcctcgaacggcgatgaagccagaaatgctagaccatggccagatgccaagcttactcaagcggcctctgcgcatgccgcggcgtcgcctcagcgcacgtcggcgacaggcgcttaaagtcttcatcgttattctgtgcttgtgtgcgtttcttttcatttttttcttctcagcgcggctgcccggcattctgcacgagcgcattactccaagtgaaaagccgtggctcacccgagcagggaactcgacgctcttcgagaaagtggttcacaaccgaatcccggggaccgcgtggcgcgatgctcacctgaacaccattatctccctcgcgaagtctggtgacgtggtgcacttgactcccactaaacacgttcgccaccgccgagccagcggcagcaactctagcacattccagaagtgggaatcactctatagaccgagcgacaggtaccatatccctgcctgggccacgccggaagaccgtgacacgctgcagcacgcgtctatctttacctccttagcttctttccgcgaccacgagtgtgcgctgacgctgcgcaaccttttcgacatggctgttgctccgcaccgcctgtacgttggtgtgagcgaggagcgcaacctgtctgacgagagctgtctctcgagcattggagtagaagacctggcaagcggtgagacgcggcgtgtgctctacggtgcagaagcgccagacacacttggcgtggaggtgcgctcgctgacgtgggcagctgtggctggatcacggcagttgctggacgtggatcaagagccgagagtgttcaccggcagtgctgccgaatctggcgcgcaacctacgggggtgtttgtacacccgtcgcacgcaatggagagggtgacgtgcattgccggggagctggaaacaacgcgtgacaggttgctcttagcggaggatgacgcgaaggaatccacagatggcaggtctgtgttccgacgcgggcgcgggggcccccagcaacagccgtcgcacgcactggctgggtgccgcgtgacgacgcgcgtgacgtaccccacgtccgcgcgcgggccgacatttggccggtacatcacaagcctgttcttttttgaccaggactactacatggtggtggacagccacacgcggttctctgtggactgggacatgaagctgatcacacgcgtgtttcagctgccgacgcggggcgtgctgtcgcactacccgaacggttaccgagaggggcatgaccgtgaggaattcgacaagacgagcgttatgctgatgtgcaccgcacaggtgctcagtaatgggatgccaaaacttggggcgcggtgggccaacgtatcgccacgcccggtcctgcagggctttgctgccgcgggcttcatgtttggggatgcgcagttcatgctggacacgccgttcgaccctttcctgccgtacattttcgacggcgaggaggtgctgtactctgcgcggatgtggacggccggctgggacctctacgggccggggcagccggacgtgtttcaccactacgggcgaatgcatacaccaaagtactttgaggtcctaacgccaactaaggctgcgcggcgtgagttgtcagagaagcgggcactgcaccttctgcggcgtgcgcacccgtggatcgaggagcttgtacgccgcggctatgtgagctctgacgggcagtcgactttgaagcctttgccgccggaggaggcgccggagacgcgactcatcgtgacagatgaagtggccgccgatacgcaggagatccgggtgtgggcgacatactacgggatgggcacggaacggcctgtggcagcttactggaagcacacggagctgtccgatgagttcgtgaaggcgaaggacgacgagcagaggtggatgggtggtactgggctgtgtgaaaaaagtgacgtcctggcgtgaggtgtgctttccaggccgctgagcggagaggtgcggagggcagtccaggaaggtggggagggaggagggatggtacccaagcgagaaggggacggacgagctcaaggctgaaagtttcagccaacggtttccggcgctgcatccgttctcatgttttggcactcgtcatatgcttttatttctgtaatcgtttttggaggagggaggaggggaggagatgtgggcgagcagagacggcggcagcagcaaaaaaaagggggggcgcccaccggcgctggtgaggcgtgcagggggaagagggtggcatgcgacatgcacaaccaaacgtgcgcgtgtgcagatgtgctggcgtgcgtcgtgagtgtgtgatttatttttgaatgacaccttatcattgctctctctgcctcacactctctcgcttccaccgctttaccttgctacgagtgtcgcttcggtataccgtcactgacgttgcctctcccctctccatactttcgctgtcactcgccgcaggaccggactggtgagtccggggtggggggggtagacttgagcacaccgtcactcatcctcagcatcacacgcttgcatctgggcaagggagagaggagctccgccttgcggaagcgcagatgagtgcagagtttagctttccattcatgctcatgctcatgctctggcgtgcaccggtgtgctcacctctccatgtacatacaccttcgggcttgcgcgtgcaccccgaagacggagagcgacagcgaagacatctctgtgcgggctgcccctgtctttgttttgggctgcttccaacctcccgcccccctctcctccatcagacccgtgcattactgagatgctcgccgcacaaaatcacgttcacaggagagacctccactttcgaagtagcgataggaaagagaatgtctaaccatgcccgatacgctttgtgggccctcgccattgctgcgcttccgtgcttttgtcgtcacagaatggcggcctccacgtccgccaccatggcgggcacgcagccatgccattcacggtctctcactgcgctctagttcctttcgtctcaaccggatcttttcctgctttcttcgtttttctcgagcatgagcgttgtcgacagcgtcttcatagcgatcgtgcccccccccccatcgagcaggcgactgctttcgagttcacacgcgtggccatgcgtactgacgtatttcaggtccaaagctaggccagcttctgaggtgcgccacctgctcatcgatgtggggtaagacgccgtgcgacggcggcagcacggacttgtgagcgcagggctgcaagagggggtgcccgagacgaagtgaaaaggaatgggggacggcctcgcaaacgctgcggctcccttcctcctcctcctcctcatctccacaactttagcgacatcgagggcgacgcagattgtgtgcggcgtcgttttcccgaatcgctcacggtttcgtggcccgcagtccacactttggcaatgcgaccggcttggacgtgtatggctggcgcgtgcgagactgaagacaacgctttcgggtgtgacgttaacaatgcgtcaaaaaaaaaaactgcgttgacgcctttgacatgtttttgacagcgtaatgccgtcagaggctggcagctgctcttgcgtctctcatgcctaccgaagaccaccggctcgctgaaggtcagacggagatggcgggtggttgggcatagtgggaacaggggagggggggggacgcgtgccatacgtgtctgcgcgtagaagggaagagggggtgggggtgggggtggggagtggcgcccaaacccaccgacgtctctacaggcatatcggcaaacagcacgacatggcagctccgcagaggaaggaggcagaccgttgctcagacaaccgtatctcaccgtgttcattacgcgccagctcctggacgcggaagtacacaccggcgaaggcgtctgttgtacattcgactacatccacccgggagcgaggacgagagcagcgtgcagaggatgggggttttctgtgcgggctgtacacatgtgcgctggcctccttttgccccgccctcgtgctttcgtcaccgtattcgtttgatgttgtgtggttgtgtgcgcccgggcttctcgttaccccaacagccatccccattcgtgggattcagcggttgtcgaccactcactacttctttcccattcttcttcttttcgatatcgtgggcatatccttttacgacgtgccggcattctgaagaacaccaaagacctgatgcgatgtgtaggaggggcatgcggacgcagcgcacgacacattgcttctgtgcgcgcaagtgccatcgaacgtacatgaggccctcggagaggcggtacagggtagtccacgctgccgtgacacctcgacgcacatgtgttgcgtgcccactcgagagtacgtgaaaataaaaaatatgtgtagaaaggtgcgagagtgcccccagctggatcctaatgcacgggtgccatctacacggtgcgtatgtctgtttatctcttcgcaccctccactatgtgtgatcctacgaacacaccgttcactcttttgccttcctgccttactgccttcctgcctcctcccttctccctcctcccttcgtttgccgccattcggatctccacccttcattgacggtcagcaacgcacgtgcttacatccgcatacacgcgacagagggcagggcatcatcttcgaaaaaaacatccgaagaacgcatagtgcaccctccctttccgttagaaagcgaagcatcaaacaagtaaaagggggcgtgtctgacgaggaaagcacctgacgagtacaaggacattcacagacgcctccggccagctgaactccccttcatttttctctgcgagccccgtatgctggagcctgggcgtttgccacgtgtctgccgtctgtgtgatcctggttgctctctcgcattgctcatcctctccctttttccccttccccctcccacgcacgtacacatacacgctgccgcgtctctgcctttgcgaggtgcgtgttgctctctctttcatacttggcaagtccttacttgtactggtgcgtgctgacgctctcctcgctcgtattgctgacgtacgtctgcgcgtgactgcaccatattgtgaggtacgtgcgctgttcattgaccagcagcagggctggtgcccaactccattcgtgtaaagcgaacagacagttgacaccacaccggcgcacaggttcatacgctaacgatgtacggtggctattacagtatgaatgctggcatgcgccagggcggtggctacggtggcggccctatgatacagcagcagcagctatatcagaatcctcgactgcaacaagtccagcaactaccatcgccaccgccgcatatgcaggcgcacctacgcggcactggacaaggtgggataccaagccacttgccgccggtaggtgctagtggaaatccgggccagctaaggcgcaacccgagtttcatgatgatgtacaacgaccgaggttttggccagccgaatccgatgatgcagcgcatgggctccttcaactcgatggggtcgatgggcatgatccctcgctttgacagctttagagcgcacggcggtggtggcaaccagccacagcgccatggtagtttttcttcgtgcgggaccggagctggcagtttgcgccgcgtcaacagcggcatgaacttcgactactcgtcagtctcgcaggtccacagaggaggctcgctcgcacgcaacaacagctatggcaccatgcggcagcctggtggaagcttcttcggcgacacttcagccccgggtggtcgagatcagcctcttcagcagctcagtcggcagaacagtgccatcagctcctacaactacggtagcttccgacagccgagttttgcacagggtagcgttcacaacggcgccaccggtgtcggcccaggcgtgtcggcgaatagtataaacggcatgttcaagctcgctgactctggcggcagcagcacagtcagccccccccaagctcctgtaaacttcggtgagagggggccaacaggtgctatgggcgcttccggggggttgcccacgttaggcctttctcgccaggacagcgccaggtcgcttcagcgcaagtactctattgctggtcagttctacaactacggtgacagcaataacggcggtgggggtgttgaccagtggggggcgcccccggtacggcagcaacgtctctcacaggctatgccgggaggcggctccatgatgggtggcggtggcatgatggcactaaacgcgaacaccgctacggttcagcaacgcggcggcatcgatcccgtgatgctgcagaggcagcagcagatgaggatgcagcagcagtcacgcatgatggcgggcggcggtagcaaaggcgtcccatcttcggacgctccatcgtcgaaggggacgtcggagagcacgatggtgcaggagggtcaaccccagatgctggggcggaagaacagtgtgcagaacttgacgcgtaaaaacagtgagaagcgagttggcatgtacttcaagaacaaggagacagagcaggacggcgttcagtacaagaaggatggcgacccgggtacctccggcaagaacagctctggtgaacggaactcgtcgcaggcgaacacggtgaaggcctccctcttgctggacatcttcaacggccggagtccagcaatcgaggtggacggccgcaccatccgcgccagcaagcctggtgccgaggaagtacagaagtacgacatgcacgatgttatgtgcgtcaaccgcatcaccgacattgaactctcgagtgactcgctagaagaaattcgagacaactttctgtacgggtgcaatgctggcctgatcatggccgattccggctgctccgctgcgcggccgaccgagtggtttacgtggctggcgttgaagtccgtggtgaaaggcacctttggcaggctggcctctgcaacgttcgagttcactgtgtcggtgtgcctcctgcaggatgatcaggtgatggacctgctttctgattcgccgcaacgcttcgtgaacttgaccgtcgcagagagcccgttgtttggtaatgtggccaatggcatggtgtacgtctgcgtcgaggatgccggtgagttcaacgatgttctggaagcgagcctgcaacgtgcgcaggagcactgcagtaccttggccgaggagcagggtattgtgctgtgtacgtgtgtgctgaagcaggtcaggacctcgccatcctccggaaaggaggacgtcatcgtctcgtccatcttcgcgagcggcgtcggtgacggtgtcattcactacaaccgtatcatcgacaagaacccggccgagccacgagcgctgttctactctgtaatgcaccgctcagttcactcgacggcactgttctcgtgcggcgtgaaagatagggatatcttcaactacctttcgacactgcagcgcttctccaagatcgagacgcgccgcccaaaggtgggtagtgctcgggccttcgtcgcctacggtaccagcgccatcccaaggatccgcgaagaactcaaggagactaaggattcccgccagcgaatgatgatgcagcggcagttggagaagctggagttgatggtggccgatgcagaggacatgcttcggtcaccggccgattgcgtacccaagacgtatatttaaacgatcgagtgtagtgcgtcatgtagatggacgcgtgcgaggcaagccttctcctctacctctccagacattgatacgcgcgccgtgggctggctcgatcatgggagatgctgtcgcccttttctaccttcgctctccttcccgtgcccgcatttccggagacaaacgagcgtgccggtgtgcatgtgtggaggggtacgcttgcttgcggtgccgccatatgtgctcactgcgtccatgaccatttcccctgtgcccccctcagacgtgccccgctgcgcagcacaggtgttcgattctcttttgtgacctcctgtactgatcccttcatgctttcacttgtttcccccatctctctcccctcttcgtcctttatcagacgtgtgtgtgtgtggatgtgtgctctgctcggtgctgtctgttgccgtcgtccagacggccatcatactcatccctttttctacgcttctttcactatgtattcctttattttacctccctccctccgtgcgtgcgtgtgtgtgtgtgtgcatgtgcgtgcgcgtgagcgactccgctctcctatgtgtatacgccttccatgaatgtgtgactgtgtacctccgggctgtggcgtgtctgccggcgttgtttctcattcgcggctgttagtgctcctctttttatttacgctgaattctgctgtcgacgtggtggggcaggagcgcgcgcacacacaaacacacacggacccttctttcgaacccctgtcgcctcagagacaggcagacgcttaccagcaaggaaaaggaaggagatgtacgaaaggcaaggggaaaaagccgctacgtttctgtgaggcatatgcgtgcgcgcacatgtgtgtgtgtgtgtgtgtggatatgtgcctgtgtgtacgttcttgggctctatttacacggattcacaatatttataatttttatcttcttgcctgtcacatg

SEQ ID NO: 82 - protein, 693 aa, Artificial Sequence
  rna_Baya_228_0070-1-p1
MLGLASSTSNGMGAGARDPLEGFEMLFNASDPLWLADETGLARKQILRHLVHIDEWLQAIRAQLPSSEKLTLAEFASNNKDALNELRRRSRSVGDSHDDAWSRMIQDRTINNVNRPNELRFFSAVGDIPETESIQPFDDIQLLKYRHQLLLNAAEEDRRVSMLLSDTVAPLPYESKHRANELKRVLYNASSIFNRRFFYPARRYQRIRPHNTESAAQTDAWYTALVLEAKRLYAPSGQDRFANASSSHRIGLGDRPSLLRLPYLSEERRRQIERHFTSAQQALMPATDRGADTETIFVSMASYRDEQCSRTLVDMMRKAKHAHRVYVGIAQQNKKGEYACITQELFMPIPCYGDREGTAAKLNGDRGALALQLHHEADAAKRVWLNFTNWGQDHLDDFGRSVCFIADHVRIRRIDSSQAKGPTYGRFMAMLLYRGESMAMVIDSHNRFTPHWDTLAVHLYHKYNDDKVVLSHYPDGYESTKDFDLYRTSSAYLCGAKFLPDFGYIRLNGIIVGDPQPFWKNNQFNIPFVPPVTEPITKANNFRMPQPWVAGGFLFANASIMREVPFDPHLNYIFDGEEVLYSVRLWTHGYNIYSPERNLMYHFYLRSSSPKLWAESPHWNSGQQRSRRRVQYLLRSRVKDLNQLHVSQDTDDPDVVVDANRYGMGPHRTVQQWYQYAGADPVRYTLDNRWCST

SEQ ID NO: 83 - protein, 906 aa, Artificial Sequence
  CFAC1_160013000.1-p1
MSSLMPGPPPVPASGLNAVAPHRATSGPNPLARDVSLKHAEARASPTQVELHPITIPVQESSVMSATTHQRHSQHSTLNTTASIAPGHRRRYLSWRVTSCFSGRVQACLRCVGFMRGDEEQRELTQRVVCACTGVAALLLLCLFLVVVLLLKVASTASTRVDGELETTRKSAGPEDDLRHLLTLDGVQRFLQQGHRAEELHQQVAAASAQPAFKRLAAQLLQVSVYVQAVQAHDPSLGLVELSDFLLNAKGRPAALERAAAAARREAAAAAGAAAGGGGAAAAGGAMVAAAAEWGAALKECLAGRGEAARVRAQLRGFVGVPAAQAERLARRPFDDVAMLQYRHAWTRSEVVPRLARVAGGGGEGGGAAVRAYDVASRAAEKADVYEAASVLNHVHYYPLRRYAAMRAYAAETVADADAWYSEVAGGVQARFGAAVAARAGGGGGGGAAAATTTAAGAAVRASPLSLLSVPYASAAREAEAAHLLTAADVGWMPEGLRAGAAVNTLTLFVSLASYRDAECPPTLLDLFRVARNPHRVYVGLAQQNRAGDTPCLLPEMYGALLCPSSGGDAVDAYAAAREAEARRRSLRGGVGADLRARHPGSGIALLDERVCFLSDHVRVRDIDSRQAKGPTYGRYMAMLLYRGEDLTMVLDSHNRFRPMWDTLGASVLAKLDDPKAALSHYPGSYTPEETKFDLYPTTTVYLCKAIFNNFFSYVQLRAMVIGDTGEFVQNNKYNDPYVTVQSSTITKAQNFRLPQPWVAGGFLFSNASIYRDVPFDPHLPYVFDGEEVLYSVRLWTHGYNIYSPPRGLCYHIYGRAKAPKLWDKNSLWYRTQDLVRPRIHFFLQSHRKKDTKLLVPADTTNAYVVVDSSRYGMGRQRTVGQWYDYAGADPVNYTLDGRWCGLALD

SEQ ID NO: 84 - protein, 1015 aa, Artificial Sequence
  EMOLV88_020005500.1-p1
MDSDVDARVRLAPSQVVSGGSLCSLKTADPGAIGASVMRTSGGATHRRGELGHYAAGTVTTPVGDSDNVHVSLARAPQASPGSRCGGSSNAKRFGAAEERLDCLLAPSFSSSHNPYESSAAAAAAAAAAAGVTGVRGRGKSTVLQHLAFFPSQVYRLLHRLRFVKDENVKDASSMLECACAAVGVLWILLFLSLAALVGVVLVVRIAVRDGQRHVEKVAGQQLDLCSHGRSGATCSTSAHLAGIGRVLDGEGLKLFAEESRRAAEWRQRLQRNASLWAELRSTRGGGDTDRRGVVNLPKVAQTLPELEHLSLLLHEVSEHVRAIHEHDPVMGLVELSNFLLHAKGRREALETAAERARAEAASAVTGTDGGAPVSGDSVAKWAAALMESFVGHSEAARLRAQLRGFIRVSAHQTERVTEQPFDDLAMLQYRHAWMRSEVLPMIRDRSLRARDRGAQVGDANAAVPPDIVSTAHHQDTSSRRSSEALMARDLANRMAVKADLYDVASIFNHIYYYPLHRYSVCCSYSSETVADTDAWYSAIAAVVQTRFGAPVTLNKVQEGEDASLPLTQRDSPLSSLALSPLGSRRVEEVGHLYTPEDRLLMPAALSSTHPVNTYSIFVSVASYRDVECAPTLLGLFRNARNPHRIHVGVVQQNRAGDIPCLLPEMYTPYLCPAEDLPGFSAENRAAGARESRARERTLYSKVLGSERLSPSSRFDARVCFLADQVRVREIDAHQAKGPTYGRYMAMLLYRGEDVTLILDSHNRFRPMWDTLGATMLRRMEDPKAVLSHYPEVHQSDTAEGNPYRTTTVYLCRARFLKDYGYLRLDGIVIASAAEYTSRNMYNDPYVSVKSSQIDQAHNFRLPQPWVAGGFLLSYATIFRDVPFDPHLSYIFDGEEVLYSVRLWTHGYNIYSPPRGLCFHMYGRSSAPKIWNDSPLWYRIQSRARARVQFLLRAHTPGSPTVMVPANTTNSFALIDSSRYGMGTQRTVDEWYKYAGADPIKNKVDGRWCGVDPAT

SEQ ID NO: 85 - protein, 1012 aa, Artificial Sequence
  LAEL147_000030200.1-p1
MDNHVTARVKRMLSPSPFGDGLDAVATAGTAVVGGPALCTAAGTECGRNERGRGPAGFAPTSMAFSSEGDGGLSGATQTSHSSNHRGPANVELRAVAEGRGYAPTHLMPKASASSSSAAAAAAVHGRGHLRPLKRLLCCASRAHRTLRALGFASDDDDPATMSQTLACSCAAVGVLLVLLLISFAALVVVLVVVMPDARQHLSQTIGPLLDSNTRRDGNTAGGGGGGDAASRASALDLKIRRLLASEGLEAFFRETHRAAELRRRVLRNATLLAALRKANAARGKDGGHGANLVSLAQTLPELERLSFLLARVSAHVRAVQEHDPVMGLVELSDFLLNAVGREAALEKAAERARAEVADAATAARGASATRDAAAEWNAALKESFAGRSEAARLRAQLRGFVGVSSSETERLTEQPFDDLALLQYRHAWVKSEVLPIMRARLRRAGARADEEDPNAAVLRNNAASHTPQNRPGHESSAPLRPQDVASRMAMKADLYEVASIFNHIHYYPLRRYSALRPYGGDSVANTDAWYSAIAAVVQTRFGVPITSNTAQTAEAAALPLIQRDSPLSVLALPRLGLERADEVAHLYTREDRQLIPHALNSKAAENTHTIFVSVASYRDMECAPTLLNLFRTARNPHRLYVGVAQQNRAGDAPCLVPELYTPYLCPSDGVQGAAGDGGVGAARELRARARTLHGKGVDLTTSTKGPEARYFDARVCLVAEHVRLREIDSSHAKGPTYGRYMAMLLYRGEDVTLVLDSHNRFRPMWDVLGATMLRRLEDPKAVLSHYPESYQGEEVDFQPYRRTTAYLCRARFLNNFGYLRLNGIVIGSTSEFAKNNVYNDPYVRVQSAEIDPATNHRLPQPWVAGGFLMSFATIFRDVPFDPHLPYIFDGEEVLYSMRLWTHGYNIYSPARGLCFHIYTRSSAPKVWSESPQWYTMQARVRQRVQFFLQTHPLNKEDVLVPANTTNPHVIIDSSRYGMGKQRTVAQWYDYAGVDPIQYKLDGRWCGVDKPD

SEQ ID NO: 86 - protein, 895 aa, Artificial Sequence
  LAMA_000035900.1-p1
MHRASASSSAAAAVHGRSHLRPLVRLLCCASRVHRTLRALGLTSDGDDPASVSQALACSCAAVGVLLVLLVISLTALVVALVVVVPDARQHLSSRKGPLLDLDTKRGGHTAASGASAVDLTMRRLVASEGLEAFLRETDRVAALRRRVQRNATLLAALRKANAARGKGGGHGLDFVGLAQTLPELEYLSFLLAQVGAHVRAVQEHDPVMGLVELSDFLLNTKGRREALEKAAERARGELANATRAAGGASAIGDAATEWNAALKELFAGRSEAARLRAQLRGFVGVSSAATERLTEQPFDDLALLQYRHAWAQSEVLPIMRARLRRAGARGGEGGPTAAVLRNNAASHTLPNRTVHASSAPLRPQDVANRMAVKVDLYEVASIFNHIHYYPLRRYSALRPYGGDSVADTDAWYSAIAAVVQTRFGVPITSNTAQTAETAALPLIQRDSLLSVLALPRLGLERADEVEHLYTREDRRLMPHALNSNAAENTHTIFVSVASYRDMECAPTLLSLFRTARNPHRLYAGVAQQNRPGDSPCLVPELYTPYLCPSDGARGAAAADGGADAARELRARARTLYGKGVDMAKSAKGPEARSFDERVCFLAEQVRLRVIDAKQAMGPTYGRYMAMLLYRGEDLALVLDSHNRFRPMWDALGATMLKRMEDPKAVLSHYPEAYDGGKVAFQPYRTTTAYLCRAHFMKNFGYLRLNAIVIRAASEFAKNNGYNDPYVRPPSSAKDSATNHRLPQPWVAGGFLLSSGTIFRDVPFDPHLPYIFDGEEVLYSVRLWTHGYNIYSPMHGICFHIYTRSSAPKVWSESPQWYAKQTHVRQRIQFFLQAHPLEKEDVLVPANTTNPYVIIDSSRYGMGKQRTVAQWYDYAGVDPIKYELDGRWCGTDKPD

SEQ ID NO: 87 - protein, 1009 aa, Artificial Sequence
  LARLEM1108_020007100.1-p1
MDNHVTTRVKRMLSPSPFGDGLDAVATAGTAVVGGPALCTAASTMCGHNERGCGPAGFAPASMTLRNEGDGRLSGATQTSHSSNHRGPSNVELRAAAEGRGYVPTHLMPKASASSAAAAAVHGRGHLRPLKRLLCCAGRAHYTLRTLGFASDDDDPANMSQALACSCAAVGVLLVLLLISFAALVVVLVVVVPDARQHLSETIGPLLDSNTRRDGNTAGGGGGGDAASRASAFDRKIRRLLVSEGLEAFFRETHRAAELRRRVLRNATLLAALRKANVARGKDGGHGVNLVSLAQTLPELEYLSFLLAQVSAHVRAVQEHDPVMGLVELSDFLLNAMGRKEALEKAAERARAEVADARTAVRGASAIGDAAAEWNAALKESFAGRSEAARLRAQLRGFVGVSSFETERLTEQPFDDLALLQYRHAWAKSEVLPIMRARSRRADARADEEGPNAAVLRNNAARHTPQNRPGHESSAPLRPQDVANRMAMKADLYEVASIFNHIHYYPLRRYSAIRPYGGDSVANTDAWYSAIAAVVQTRFGVPITSNTAQTAEAAALPLIQRDSPLSVLALPRLGLGRADEVAHLYTREDRQLMPHALDSKAAESTHTIFVSIASYRDMECAPTLLNLFHTARNPHRLYVGVAQQNRAGDTPCLVPELYTPYLCPSDGVQGAAGDGGVGAARELRARARTLHGKGVDLTTSTAGPEARYFDARVCLLAEQVRLREIDSSQAKGPTYGRYMAMLLYRGEDVTLVLDSHNRFRPMWDVLGATMLRRLEDPKAVLSHYPESYRGEEADFQPYRTTTAYLCRAHFMNNFGYLRLNGIVIGSTSEFTKNNVYNDPYVRVQSAEIDPATNHRLPQPWVAGGFLMSFATIFRDVPFDPHLPYIFDGEEVLYSMRLWTHGYNIYSPARGLCFHIYTRLSAPKVWSETPQWYAMQTRVRQRIQFFLQSRPLNKEDVLVPANTTNPHVIIDSSRYGMGKQRTVAQWYDYAGVDPIKYKLDGRWCGVDKPD

SEQ ID NO: 88 - protein, 863 aa, Artificial Sequence
  LbrM.02.0270:mRNA-p1
MLRLLGFVNDDDDPADVSQTLVCACTAVGALLVLLLINFAALVVVLVVMVPAAQRQLPQTAQSLLDFNHENKSGTADGAALASGLDIRRLLAGGGLETFLREAHRAEELRRRVQGNATLLAALRKANEARNNDGGRGVDLVRLAQTLPELEYLSFLLYQVSAHVQAVQERDPVMGLVELSDFLLNAKGRREALEKAAERARAEAVNATTAATVGGGARATGGGSVEKWNAALKESFAGRSEAARLRAQLRGFIGVASSEAERLTQQPFDDLALLQYRHAWMQSEVLPIMRSRSRRAGAQAVKEGPHAAVLRSNTASRPPENTSVRTSVEELRVYGVANRMAMKAVLYEVASIFNHIYYYPLRRYEALRPYGGDSVADTDAWYSAITAAVQTRFGVPIACNKAQTTEAAALPLVLRDSPLSVLALSRLGFRRAEEVAHLYSQEDRQLMPQALNPKAAVNVRSIFVSFASYRDAECASTLLDLFRAARNPHRLYVGIAQQNRAGDSPCLVPEMYTPYLCPSEGLQGAAADGGVGAARESRARARALYGEGADLTKPPNGPEARHFDERVCFLAEQVRVREIDSGQAKGPTYGRYMAMLLYRGEGLALVLDSHNRFRPMWDALGATMLLRLEDAKAVLSHYPESYPGEKADLLPYRRTTAYLCRAHFLKPFGYIRLNGIVIDSTAEFAKNNVFNDPYVRVKSREIDPTTNYRLPQPWVAGGFLMAFGTIFRDVPFDPHLSYIFDGEEVLYSMRLWTHGYNLYSPPRGVCFHIYGRQEAPKVWSESALWYNLQNRVRSRIQFYVQAHLLHAEKVLVPANSTNPFVVMDSSRYGMGKQRTVAQWYDYAGIDPVKHQVDGRWCGEDVIH

SEQ ID NO: 89 - protein, 902 aa, Artificial Sequence
  LdCL_020007500-t42_1-p1
MPKASASSAAAAAAVHGRGHLRPLKRLLCCASRVHRTLRALGFASDDDDPANMSQMLACSCAAVGVLLVLLLINFAALVAVLVIVVPDARQHLSHTIGPLLDSNTRRDGNTAGGGGGDAASRASALDLKIRRLLASEGLEAFLRETRRAAELRRRVRRNATLLAALRKASAARGKVGGHGVDLVSLAQTLPELEHLSFLLAQVSVHVRAVQEHDPVMGLMELSDFLLNAKGRKEALEKAAERARAEGADATTAARGASTIGDAAAEWNAALKESFAGRSEAARLRAQLRGFVGVSSFETERLTEQPFDDLALLQYRHAWTKSEVLPIMRARFRRAGARADEEGPNAAVPRKNAASHTPQNRPGHESSAPLRPQDVANRVAMKADLYEVASIFNHIHYYPLRRYSALRPYGGDSVADTDAWYSAIAAVVQTRFGVPITSNTAQTAEAAALPLIQRDSPLSVLALPRLGLERAKEVAHLYTREDRQLIPHALNPKAAENTHTVFVSVASYRDMECAPTLLNLFRTARNPHRLYVGVAQQNRAGDSPCLVPELYTPYLCPSNGVQGAAGDGGVGAARELRARARTLYGKGVDLTTSTTGPEAHYFDARVCLVAEQVRLREIDSSQAKGPAYGRYMAMLLYRGEDVTLVLDSHNRFRPMWDVLGTTMLRRLEDPKAVLSHYPEGYQGEGVDFQPYRTTTAYLCRAHFMNSFGYLRLNGIVIGSTSEFAKNNVYNDPYVRVQSSEIDPATNHRLPQPWVAGGFLMSFGTIFRDVPFDPHLPYIFDGEEVLYSTRLWTHGYNIYSPARGLCFHIYTRSSAPKVWSESSQWYTMQTRVRQRIQFFLQTHPFSKEDVLVPANTTNPYVIIDSSRYGMGKQRTVAQWYEYAGVDPIKYKLDGRWCGVDKPD

SEQ ID NO: 90 - protein, 1002 aa, Artificial Sequence
  LENLEM3045_000029600.1-p1
MDRHVTARVKRMLPLSPFGNDSGDVATSGISAAGGLVLRAAARTETDSSEHGHGPASFVPATMVVGDDCDGGLPGIAQTSHGGHPRGLANGERVTVPDSGGYVPAQSSHKAFAAGLHCHRKVRLMKRLASCAGSIHRALRALGLVDNDDDAANLSQTLACACAAIGVLVALLLISFAALVAVLVVVVPNAQLLPSQGIGPSVVRNENGGGTARGGAASGARGSDFDAGRLMADRDLSAFLRDARRAEEWRRRIRRNATLLAALRKANAARSMNGGRGADLLSLVQTLPELERLSLLLYQVSAYVQALQVHDPVMGLVELSDFLLNAKGRKEALAKAAERARAEAADRTRATAAGGGVPTVEGSVAEWNAALKESFAGRSEAARLRAQLRGFIGVSSFETERLAEQPFDDLAVLQYRHAWAMSEVLPMMRAHSRRVVASAADKGSRAARLRNYGGIRPPQNASAGASAEALEARDIANRMAMKADLYEVASIFNHIYYYPLRRYTALRPYGGHSIADTDAWYSAIAAAVQARFGAPITCNKVGTTEAAALPLTQRDAPLSALTLPRLGFERAEEVAHMFSSRDRRLMPQALDLKASVNTNTIFVSLASYRDAECAPTLLSLFRTARNPSRLYIGLAQQNRAGDSPCLVPEMYAAFLCPSGGLQGAAADDDVAAARESRARARTLYGEGADFTKDTSNPEARHFDERACFLAEQVRIREIDSRQAKGPTYGRYMAMLLYRGEDLALVLDSHNRFRPMWDTFAATMLLRLEDPKAVLSHYPESYPGEGADLRPYRRTSAYLCRAHFLKDFGYVRLGAIVILSSAQFAKNNVYNDPYVRVKSRDMDSTSNFRLPQPWVAGGLLMSYGTIFRDVPFDPHLPYIFDGEEVLYSMRLWTHGYNIYSPALGFCFHIYGRSSAPKVWSESPVWYSMQSRVRKRIQFFLQTHLLDKEEVMVPANSTNPFVVTDSSRYGMGKQRTVAQWYDYAGVDPIRYQVDGRWCGKDDTV

SEQ ID NO: 91 - protein, 1010 aa, Artificial Sequence
  LGELEM452_020006800.1-p1
MDNHVTTRVKRMLSPSPFGDGLDAVATAGTAVVGGPALCTAASMMCGHNERGRGPAGFAPASMALSNEGDGGLSGATQTSHSSSHRGLSNVELRAAAEGRGYAPTHLMPKAPGSSSAAAAAVHGRGHLRPLKRLLCCASRAHYTLRALGFASDDDDPANMSQTLACSCAAVGVLLVLLLISFAALVVVLVVVVPDARQHLSQTIGPLLDSNTRRDGNTAGGGGGGDAASRASAFDRKIRRLLASEGLEAFFRETHRAAELRRRVLHNATLLAALRKANAARGKGGGHGVNLVSLAQTLPELEYLSFLLAQVSAHVRAVQEHDPVMGLVELSDFLLNTMGRKEALEKAAERARAEVADARTAARGASAIGDAAAEWNAALKESFAGRSEAARLRAQLRGFVGVSSFETERLTEQPFDDLALLQYRHAWAKSEVLPIMRARLRRAGARADEDGPNAAALRNNAASHTPQNRPGHESSAPLRPQDVANRMAMKADLYEAASIFNHIHYYPLRRYSAIRPYGGDSVANTDAWHSAIAAVVQTRFGVPITSNTAQTAEAAALPLIQRDSPLSVLALPRLGLERADEVAHLYTREDRQLIPHALDSKAAESTHTIFVSIASYRDMECAPTLLNLFRTARNPHRLYVGVAQQNRAGDTPCLVPELYTPYLCPSDGVQDAAGDGGVGAARELRARARTLHGKGVDLTTSTAGPEARYFDARVCFVAEQVRLREIDSSQAKGPTYGRYMAMLLYRGEDVTLVLDSHNRFRPMWDVLGATMLRRLEDPKAVLSHYPESYRGEEVDFQPYRTTTAYLCRAHFMNNFGYLRLNGIVIGSTSEFAKNNVYNDPYVRVQSAEIDPATNHRLPQPWVAGGFLMSFATIFRDVPFDPHLPYIFDGEEVLYSMRLWTHGYNIYSPARGLCFHIYTRLSAPKVWSETPQWYATQTRVRQRIQFFLQTRPLNKEDVLVPANTTNPHVIIDSSRYGMGKQRTVAQWYDYAGVDPIKYKLDGRWCGVDKPD

SEQ ID NO: 92 - protein, 902 aa, Artificial Sequence
  LINF_020007400-T1-p1
MPKASASSAAAAAAVHGRGHLRPLKRLLCCASRVHRTLRALGFASDDDDPANMSQMLACSCAAVGVLLVLLLINFAALVAVLVIVVPDARQHLSHTIGPLLDSNTRRDGNTAGGGGGDAASCASALDLKIRRLLASEGLEAFLRETRRAAELRRRVRRNATLLAALRKASAARGKDGGHGVDLVSLAQTLPELEHLSFLLAQVSVHVRAVQEHDPVMGLMELSDFLLNAKGRKEALEKAAERARAEGADATTAARGASTIGDAAAEWNAALKESFAGRSEAARLRAQLRGFVGVSSFETERLTEQPFDDLALLQYRHAWTKSEVLPIMRARFRRAGARADEEGPNAVVPRKNAASHTPQNRPGHESSAPLRPQDVANRVAMKADLYEVASIFNHIHYYPLRRYSALRPYGGDSVADTDAWYSAIAAVVQTRFGVPITSNTAQTAEAAALPLIQRDSPLSVLALPRLGLERAKEVAHLYTREDRQLIPHALNPKAAENTHTVFVSVASYRDMECAPTLLNLFRTARNPHRLYVGVAQQNRAGDSPCLVPELYTPYLCPSNGVQGAAGDGGVGAARELRARARTLYGKGVDLTTSTTGPEAHYFDARVCLVAEQVRLREIDSSQAKGPAYGRYMAMLLYRGEDVTLVLDSHNRFRPMWDVLGTTMLRRLEDPKAVLSHYPEGYQGEGVDFQPYRTTTAYLCRAHFMNSFGYLRLNGIVIGSTSEFAKNNVYNDPYVRVQSSEIDPATNHRLPQPWVAGGFLMSFGTIFRDVPFDPHLPYIFDGEEVLYSTRLWTHGYNIYSPARGLCFHIYTRSSAPKVWSESSQWYTMQTRVRQRIQFFLQTHPFSKEDVLVPANTTNPYVIIDSSRYGMGKQRTVAQWYEYAGVDPIKYKLDGRWCGVDKPD

SEQ ID NO: 93 - protein, 1011 aa, Artificial Sequence
  LmjF.02.0240:mRNA-p1
MDNHVTTRVKRMLSPSPFGDGLDAVATAGTAVVGGPALCTAVSTMCGHNERGRGPAGFAPASMSLSSEGDGRLSGATQTSHSGNHRGPSNVELRATAEGRGYAPTHLMPKASASSSAAAATAVHGRGHLRPLKRLLCCASRAHYTLRALGFASDDDTPAKMSQTLACLCAAVGVLLVLLLISFAALVVVLVVVVPDARQHLSQTIGPLLDSNTRRDGNTAGGGGGGDAASRASAFDRKIRRLLASEGLEAFFREAHRAAELRRRVLRNATLLAALRKANAARGKDGGHGVNLVSLAQTLPELEYLSFLLAQVSAHVRAVQEHDPVMGLVELSDFLLNATGRKEALEKAAERALAEVADARPAARGASTIGDAAAEWNAALKESFAGRSEAARLRAQLRGFVGVSSFETERLTEQPFDDLALLQYRHAWAKSEVLPIMRARLRRAGAQADEEGPNAAALRNNAVSHTPQNRPGHESSAPLRPQDVANRMAMKADLYEVASIFNHIHYYPLRRYSAIRPYGGDSVANTDAWYSAIAAVVQTRFGVPITSNTAQTAEAAALPLIQRDSPLSVLALPRLGLERVDEVAHLYTREDRQLMPHALNSKSAESTHTIFVSIASYRDMECAPTLLNLFRTARNPHRLYVGVAQQNRAGDTPCLVPELYTPYLCPSDGVQGAAGDGSVGAARELRARARTLYGKGVDLTTSTEGPEARYFDARVCLVAEQVRLREIDSSQAKGPTYGRYMAMLLYRGEDMTLVLDSHNRFRPMWDVLGATMLRRLEDPKAVLSHYPESYRGEEADFQPYRTTTAYLCRAHFMNKFGYLRLNGIVIRSASEFAKNNVYNDPYVRVQSAEIDPATNHRLPQPWVAGGFLMSFATIFRDVPFDPHLPYIFDGEEVLYSMRLWTHGYNIYTPARGLCFHIYTRSSAPKVWSETPQWYTTQTRVRQRIQFFLQTRPLNKEDVLVPANTTNPYVIIDSSRYGMGKQRTVAQWYDYAGVDPIKYKLDGRWCGVDKPD

SEQ ID NO: 94 - protein, 895 aa, Artificial Sequence
  LmxM.02.0240.1-p1
MHRASASSSSAAAVHGRSHLRPLARLLCCASRVHRTLRALGLTSDGDDPASVSQALACSCAAVGVLLVLLVISLAALVVVLVVVVPDARQHLSSRMGPLLDLDTKRGGHTAASGASAVDLTMRRLVASEGLEAFLRETDRVAALRRRVQRNATLLAALRKANAARGKDGGHGLDLVSLAQTLPELEYLSFLLAQVGAHVRAVQEHDPVMGLVELSDFLLNAKGRREALEKAAERVRGELANATPAAGGASAIGDAATEWNAALKELFAGRSEAARLRAQLRGFVGVSSAATERLTEQPFDDLALLQYRHAWVQSEVLPIMRARLRRAGARGGEGGPTAAVLRNNAASHTLPNRAVHASSAPLRPQDVANRMAVKVDLYEVASIFNHIHYYPLRRYSALRPYGGDSVADTDAWYSAIAAVVQTRFGVPITSNTAQTAEAAALPLIQRDSLLSVLALPRLGLERADEVEHLYTREDRRLMPHALKSNAAENTHTIFVSVASYRDMECAPTLLSLFRTARNPHRLYAGVAQQNRPGDSPCLAPELYTPYLCPSDGARGAAAADGGSDAAREVRARARTLYGKGVDMTKSAKGPEARSFDERVCFLAEQVRLRVIDAKQAKGPTYGRYMAMLLYRGEDLALVLDSHNRFRPMWDALGATMLRRMEDPKAVLSHYPEAYDGGKVAFQPYRTTTAYLCRAHFMMNFGYLRLNAIVIRAASEFAKNNGYNDPYVRPPSSAKDSATNHRLPQPWVAGGFLLSSGTIFRDVPFDPHLPYIFDGEEVLYSVRLWTHGYNIYSPMRGICFHIYTRSSAPKVWSESPQWYAKQTHVRQRIQFFLQAHPLDKEDVLVPANTTNPHVIIDSSRYGMGKQRTVAQWYDYAGVDPIKYELDGRWCGTDKPD

SEQ ID NO: 95 - protein, 863 aa, Artificial Sequence
  LPMP_020160-t37_1-p1
MLRLLGFVNDDDDPADVSQTLVCACTAVGALLVLLLINFAALVVVLVVMVPAAQRQLPQTAQSLLDFNHKNKGGTADGAALASGLDIRRLLAGGGLETFLREAHRVEELRRRVQGNATLLAALRKANEARNNDGGRGVDLVRLAQTLPELEYLSFLLYQVSAHVQAVQERDPVMGLVELSDFLLNAKGRREALEKAAERARAEEVNVTTAATVGGGARATGGGSVEKWNAALKESFAGRSEAARLRAQLRGFIGVASSEAERLTQQPFDDLALLQYRHAWMQSEVLPIMRSRSRRAGAQAVKEGPHAAVLRSNTASRPPENTSVRTSVEELRVYGVANRMAMKAVLYEVASIFNHIYYYPLRRYEALRPYGGDSVADTDAWYSAITAAVQTRFGVPIACNKAQTTEAAALPLVLRDSPLSVLALSRLGFRRAEEVAHLYSQEDRQLMPQALNPKAAVNVRSIFVSFASYRDAECASTLLDLFRAARNPHRLYVGIAQQNRAGDSPCLLPEMYTPYLCPSEGLQGAAADGGVGAARESRARARALYGEGADLTKPPNGPEARHFDERVCFLAEQVRVREIDSGQAKGPTYGRYMAMLLYRGEGLALVLDSHNRFRPMWDALGATMLLRLEDAKAVLSHYPESYPGEKADLLPYRRTTAYLCRAHFLKPFGYLRLNGIVIGSTAEFAKNNVFNDPYVRVKSREIDPTTNYRLPQPWVAGGFLMAFGTIFRDVPFDPHLSYIFDGEEVLYSMRLWTHGYNLYSPPRGVCFHIYGRQEAPKVWSESALWYNLQNRVRSRIQFYVQAHLLHAEKVLVPANSTNPFVVMDSSRYGMGKQRTVAQWYDYAGIDPVKHQVDGRWCGEDVTR

SEQ ID NO: 96 - protein, 900 aa, Artificial Sequence
  rna_LpyrH10_27_0530-p1
MSSAVRVSPPVLGECAVDAVPTTGAVLAGPVHRTFTDDNVRVREVAGAVSPSVFVDGSPNSAGGPLPHTRSGKYFASSHAAAAAPSLSSPASKERSSGGSGGSSRRRLLRRILCCPHRIQLCLRSAVPLKENRGAREASPLRVCAGTATAVLLALLFIGTVIFIVVLVVLLTGARQLPERQTLAPMRFETRSAGAAGVRHDSDGVIAASLDNVRHLLTAERLQHFLQRTPAAEEERRRALRNDTLPAAARDVGDLVGLARTLPEQQRVSAQLARVRAYVAAVHAHDAGVGLAELSDFLRSVPGRGAALERAASKAAGSPGVAAALAGRAAGARVRALLRGFVAAPAGQAERVGLRPFDDVAMLRYRHAWMLSEVVPRLAGRTRGGGGGGPVSAADVARGAARKAELYEAASVFNHVYYYPLRRYAAMQAFSPATVADTDAWYTEVAAGVQARFGAAQAVAALSLPLLPAARAAEVAHLREPDDMEWMPAGLRADAAVNRQTIFISLASYRDTECAPTVLDLFRAARNPYRVYVGLAQQNVAGDTPCLLPEMYGPFLCPSAGEALDAAAAAREAEARRRSLGGGDGVDFRLVHPGSDAAHFDERVCFLADHVRVRDIDARQAKGPTYGRYMAMLLYRGEAVAMVLDSHNKFRPMWDTLGASLLRRYDDPKAALSHYPQAYDPEKESKLDVYARTTAYLCKAVFHNIFAYLQLRAMVIGEADEFANNMRYNAPYVATVEEKAPVRSYRLPQPWVAGGFLLTNSTIFRDVPFDPHLPYVFDGEEVLYSARLWTHGYNIYSPPRGLCFHIYGRPKAPKVWDVTALWYAVQDRVRPRIQFFLQSHLKGRPGLIVPADTTNAYAVVDASRYGMGRQRTVAQWYDYAGADAVNYTLDGRWCGVDTTT

SEQ ID NO: 97 - protein, 955 aa, Artificial Sequence
  rna_Lsey_0379_0030-1-p1
MPLALRALPSSQPDGEAEAAITADALHTSAAHHTLSEKAVRAGNLTHFESLPVFVDGAPSGASVLLSTVASHTQTAKHRAFSHLRAALFSSSASGERASSAGRLLRRMMCCTTRLRRCLRSFGFLKAEGNAHDLAQLLVCACTAVAVLLVLLLLAVGLLIVVFVVLVPGAQLQLQQTVKPSLDLNHPDMHTTNRSPAGKGGNQGDVSQLSYSDLHRVLEAAGLTQFLQQALDVEKLRRHLLRNEALLVSMRGMREKDGPAQGTDDLARLVQGRTELERLSGQLLQVAVYIGAVHAHDPRLGLVELSDFLLDVKGRGAALGRAAEQARRDAVTTAATSGSGGRVMPAETGGPSVGWTAELKTVLADHTQSARLRAQLPGFVGVPAGQEERWTRQPFDDVAMLQYRHAWARSEVLPRLGRAGSSGRAGAGAVSAHDVAKRAALKADLYDVASIFNHVHYYPLRRYTAMQAFSPATVADTDAWYSEVVAGVQARFGAAVSGGGASGAAESIAVRDSPLSLLSLPRLPTAREDEVTRLLTREDAAWMPAGLRAGAAVNRQTIFVSLASFRDMECAPTVLDLYRTARNPHRVYVGLALQNHVGDMPCLLPEMYGPFLCPSSGDVLDAHAAAREVAARRRSLRGDGADFTKRSDSDVALFDKRVCFLPDQIRVRDIDATHAKGPTYGRFMAMLLYRGEELAMVLDSHNRFRPLWDTLGVSLLQRFGEPKTALSYYPEAYNPTDAHFNAFRTTTAYLCKAFFLSNFGYLRLNAMVISSPAEFTQNNRYNDAFVAVQSNTIQQSQNFRLPQPWVAGGFLFTNATIFRDVPFDPHLDYIFDGEEVLYSVRLWTHGYNIYSPPLGLCFHIYGRTKAPKIWSESAAWYSLQSRSRPRIQFYLQSHSKGNPNLLEPANTTNAYVVVDSSRYGMGRQRTVSQWYDYAGADPVNYTLDGRWCGIDQVTQ

SEQ ID NO: 98 - protein, 1011 aa, Artificial Sequence
  LTRL590_020007500.1-p1
MDNHVTARVKRMLSPSPFGDGLDAVATAGTAVVGGPALCTAAGTECGRNERGRGPAGFAPTSMAFSNEGDGGLSGATQTSHSSNHRGPANVELRAVAEGRGYAPTHLMPKTSASSSAAAAAAAVHGRGHLRPLKRLLCCAGRAHRALRALGFASDDDDPASMSQTLACSCAAVGVLLVLLLISFAALVVVLAIVVPDARQHLSQTIGPLLDSNTRRDGNTAGGGGGDAASRASALDLKIRRLLASEGLEAFFRETHRAAELRRRVLRNATLLAALRKANAARGKGGGHGANLASLAQALPELEHLSFLLAQVSAHVRAVQEHDPVMGLVELSDFLLNAMGREAALEKAAERARAEVADAATAASGAPATGAAAAEWNAALKESLAGRSEAARLRAQLRGFVGVSSSETERLTEQPFDDLALLQYRHAWAKSEVLPIMRARLRRAGARADEEGSNAAVLRNNAASYTPQNRPGHESSAPLRPQDVANRMAMKADLYEAASIFNHIHYYPLRRYSALRPYGGDSVANTDAWYSAIAAVVQTRFGVPITSNTAQTAEAAALPLIQRDSPLSVLALPRLGLERADEVAHLYTREDRQLIPHALNSKAAENTHTIFVSVASYRDMECAPTLLNLFRTARNPHRLYVGVAQQNRAGDAPCLVPELYTPYLCPSDGVQGAAGDGGVGAARELRARARTLHGKGVDLTTSTKGPEARYFDARVCLVAEHVRLREIDSSQAKGPTYGRYMAMLLYRGEDLTLVLDSHNRFRPMWDVLGATMLRRLEDPKAVLSHYPESYRGEEADFQPYRRTTAYLCRARFMNNFGYLRLNGIVIGSTSEFAKNNVYNDPYVRVQSAEIDPATNHRLPQPWVAGGFLMSFATIFRDVPFDPHLPYIFDGEEVLYSMRLWTHGYNIYSPARGLCFHIYTRSSAPKVWLESPQWYTMQTRVRQRVQFFLQTHPLNKEDVLVPANTTNPHVIIDSSRYGMGKQRTVAQWYDYAGVDPIKYKLDGRWCGVDKPD

SEQ ID NO: 99 - protein, 1011 aa, Artificial Sequence
  LTULEM423_020006600.1-p1
MDNHVTTRVKRMLSPSPFGDGLDTVATAGTAVVGGPALCTAASTMCGHSERGRGPAGFAPVSMALSSEGDGGLSGATQTSHSSNHRGLSNVELRAAAESRGYAPPTHLMPKASASSSTAAAAVHGRGRLRPLKRLLCCASRAHYTLRALGFASDDDDPANMSQTLACSCAAVGVLLVLLLMSFAALVVVLVVVVPDARQHLSQTIGPLLDSNTRRDGNTAGDGGGGDAASRASAFDRKIRRLLASEGLEAFFRETHRAAELRRRVLRNATLLAALRKANAARGKDGGHGVNLVSLAQTLPELEYLSFLLAQVSAHVRAVQEHDPVMGLVELSDFLLNAMGRKEALEKAAERARAEVADARTAARGASAIGDAVAEWNAALKESFAGRSEAARLRAQLRGFVGVSSFETERLTEQPFDDLALLQYRHAWAKSEVLPIMRARLRRAGARADEEGPNVAALRNNAARHTPQNQPGHESSAPLRPQDVANRMAMKADLYEAASIFNHIHYYPLRRYSAIRPYGGDSVANTDAWYSAIAAVVQTRFGVPITSNTAQTAEAAALPLIQRDSPLSLLALPRLGLERADEVAHLYTREDRQLIPHALDSKAAESTHTIFVSIASYRDMECAPTLLNLFRTARNPHRLYVGVAQQNRAGDTPCLVPELYTPYLCPSDGVQGAAGDGGVGAARELRARARTLHGKGVDLTTSTAGPEARYFDARVCLVAEQVRLREIDSSQAKGPTYGRYMAMLLYRGEDVTLVLDSHNRFRPMWDVLGATMLRRLEDPKAVLSHYPESYQGEEVDFQPYRTTTAYLCRAHFMNNFGYLRLNGIVIGSTSEFAKNNVYNDPYVRVQSAEIDPATNHRLPQPWVAGGFLMSFATIFRDVPFDPHLPYIFDGEEVLYSMRLWTHGYNIYSPARGLCFHIYTRSSAPKVWSETPQWYAMQTRVRQRVQFFLQTRPLNKEDVLVPANTTNPHVIIDSSRYGMGKQRTVAQWYDYAGVDPIKYKLDGRWCGVDKPD

SEQ ID NO: 100 - protein, 749 aa, Artificial Sequence
  Tbg.972.2.950:mRNA-p1
MHYASRGAKRQNQLRLPPAQKPGRLRVLARSFRGVNDAVGDFTQRNNESPLLYALLFVVGLLILLFIVLFVVLLCILLRSDGWSTIDAFSSKTHIVEDPDKSALLEIRRLYDTMMRTGSDREATALLEFLSTYQRSMEARVSKSTHGDDENAGDNGNVGDSGVPQGKSKYASEKPRVSNGTSLSQRSFAEVLADVRETIQDIMTLDPDVGLDRAAFFVKEKFGASNDDRSQRTDSTGSHDIERGEVEAFEPFDDILYLQLLSFFAKEEPTRSISSADRLWWRRKRISAPSVMEGRFYYPLRRFHRMQSFSPDTISTVAAWFDTMALDYYGEEMEPFESSLQQSYEGAQVSNHSGSSPENPEIKEHAVSFSPSHTASIFVSVASFRDVECQSTLQQVVHRATNMFRTYVGIAEQHNKSDPPCLSYDLFQPTLCPSAAIASDTASARAVFSDVLCFPMDNIRLRHIAPDAARGPTYGRYMTMLLYRGEDYVLILDSHTRFVYGWDSRVVAMHMYLRHPRIVLSHYPEGFEKELSNFTYERTTTVYLCRASFIESDGYVRLGGILVNEENVNKFSHQGRVLRYAAKGFGRKPDADVSRPLPQPWAAGGFLFARGSIMREVPLDPHLPNTFDGEEVLYSVRLWTHGYDIHSPNRTICYHVYTRNDQPKVWNNNPLWSSLRLRSRERIQCLLQTREKGQTVPKVPVNTTDPAVTIDVDRYGMGRVRTVENWYRFAGLDPVRYTFDGRWCGKGKI

SEQ ID NO: 101 - protein, 782 aa, Artificial Sequence
  TcIL3000_0_43290.1-p1
MPYGSLVERSRLRRAGRPGLTQLVPMEIKPPQSSGWRSILHPFFTCVRSMIEDLTRVNSGRLYFCRAFFSVVFLALLVITLILVAVVLMPSAPSPDVREPSTFMGEAVAKRVQSNTLWEVCKLFAAQVRANGAHVEESLKEFLLRCQQEPSDHTGNISTNSHMNNVEDAARNDSNVGHDTRSPPQFSEGSVTKPGANMTLMSDSPFAERRDISEVMDELRLTVNFIMAHDPDGGLEHLANFMKKRLSPARVVDERGPETTAATSDWEETEAFQPFDEILYLQLSSFFAKHGNEGSITTRQARLWWRQKAVEVSSVVTGRFYYPLRRFHRAQQYSSETADTVNAWLSAMMEDFCDEEMEPLVSPPSSSPKRTLRQAGGNEQLLSRGENILKGLKTNGYASIAPPNSKLHTASIFVNVASYRDEECWPTVRQSVERAANMFRVYFGIAEQHLDTDLSCVSYDMLLPEPCTVPTDVPWAKNKGFDFDGAICFPVDNIRRRQIAPAAAYGPTYGRFVAMLLYRGEDYAFVLDSHTRFVFAWDSRITAMYMEMDHPRLVLSHYPEGYNTSDTHFNYERASTVYLCRASFVESDGYIRLDGIVISESEGSRIFRRRFVRPYASGGTSPEVYAGSRRPLPQPWAAGGFLFANASIMREVPFDPHLPNTFNGEEVLYSVRLWTHGYDIHSPKRSICYHIYTRKGQPKVWENNTHWEALRQKSRQRIQYLLQSRVKGTSTLLVPLNTTDPVVVVDKARYGMGRLRSVDAWYNFSGVNSVDYTVDGRWCGKK

SEQ ID NO: 102 - protein, 747 aa, Artificial Sequence
  TevSTIB805.2.1330-t26_1-p1
MHYASRGAKRQNQLRLPPAQKPGRLRVLARSFRGVNDAVGDFTQRNNESPLLYALLFVVGLLILLFIVLFVVLLCILLRSDGWSTIDAFSSKTHIVEDPDKSALLEIRRLYDTMMRTGSDREATALLEFLSTYQRSMEARVSKSTHGDDENAGDNGNVGDSGVPQGKSKYASEKPRVSNGTSLSQRSFAEVLADVRETIQDIMTLDPDVGLDRAAFFVKEKFGASNDDRSQRTDSTGSHDIERGEVEAFEPFDDILYLQLLSFFAKEEPTRSISSADRLWWRRKRISAPSVMEGRFYYPLRRFHRMQSFSPDTISTVAAWFDTMALDYYGEEMEPFESSLQQSYEGAQVSNHSGSSPENPEIKEHAVSFSPSHTASIFVSVASFRDVECQSTLQQVVHRATNMFRTYVGIAEQHNKSDPPCLSYDLFQPTLCPSAAIASDTASARAVFSDVLCFPMDNIRLRHIAPDAARGPTYGRYMTMLLYRGEDYVLILDSHTRFVYGWDSRVVAMHMYLRHPRIVLSHYPEGFEKELSNFTYERTTTVYLCRASFIESDGYVRLGGILVNEENVNKFSHQGRVLRYAAKGFGRKPDADVSRPLPQPWQRVGFSSLEVLLCVRFPSILISPIPSMVKKCCIPCGCGLMAMISTPPTVPSVIMCTPVMISRGVENPLWSSLRLRSRERIQCLLQTREKGQTVPKVPVNTTDPAVTIDVDRYGMGRVRTVENWYRFAGLDPVRYTFDGRWCGKGKI

SEQ ID NO: 103 - protein, 786 aa, Artificial Sequence
  DQ04_09771010-t26_1-p1
MPMNNDTPPQQSLLHRRGHDPALHNRHATAVPVDNTNTSSSKKRGLYRVYNDIQKWFRSDNNIICVLILNVVVLLVMCLALAGVCAWLLLYAPVYEPSPQMEKRFDDDAVLDVWRLYETASRTNDEYHKSALRRYLLQYKLTAEARRRNSSRVAKAGAPRVPLDVPDVFDPKAAVLPKYTTEPQQNLTCVIEALHAAISRIAAQQPNGGLDRAADFVEKEFRHGAENGGAPITAAAGRGTISANAEESGHETEADAPFDDILYIQLRRFFIGTSKHAGEEDGGAFPAYGNSPADDPVLRAWWRRLQSAAPSVYVNRFYYPLRRYHRMRRFSPETPAATAAWYDAVAYDYYHDYYSDSSNMSDRNVVKFTPPHVPEAYPASIADAVANSDAASLPLDTPAHTATIFVSVASYRDKECWPTVQHMMQRATNMFRVYIGIAEQHRATDPPCVSDTALQPLPCVGAQPSPASSGMTAARNAAEGIGGLGMLKRADYEGAVCFLGDNIRVRHIRPSASYGPTYGRYMAMLLYGGEDYTLVLDSHNRFVYAWDTRIVAMHAAMRHPKLVLSHYPESYVQEDSNFAWERTTTAYLCRAVFLDTAGYVRLNGIVVSSNEQHKANSRYLTPYTLAALRLEPGVVRLLPQPWAAGGFLFSTSSILREVPFDPHLPHIFDGEEVMYSVRLWTHGYDIHSPKRGICYHFYGRKGEPKVWTEARRWSAVQSESRKRIQYLLRARIRGVDVLRIAKGTPDPVVMVDVDRYGVGRLRGVDDWYKFAGVDPVNYTTDGRWCG

SEQ ID NO: 104 - protein, 722 aa, Artificial Sequence
  TRSC58_00083-t26_1-p1
MRLDESSVFRRHNSHRQRSVEAAETERYDGRSHRPGAKPARTLRQAVGAYLSSDARVINFLLVAIVILIVVCLGLIGLSAWLLLHGAGNASAFGSSRKFFDNNAVMDIWRLYDAAQRSGDEYHKTALHEYLTRYKNRVEERREAWNLQHNVTEIDIKDDTGGDEPILPPYTSSPTMRLPSLMASLRTIINRIESRDPEKGLERAAAFVEEQMKEAVAISSDTGEVVEEGEAVEPLDDILYLQLRRLHESAKHDAAAPATPHRVWWECVKAAAPSVYTKRFYYPLRRFHRMRRFSVETQAVTAAWFDALVDDYYGDNVTHFSPPTLPTGFDALMAQAIADSEAASASLASPAHTGSLFVNIASFRDKECWPTVDHMIQRATNMFRVYWGIAQQNYYTDLPCVSVDALEPRPCLAAPITPGLVLSDAKYDGAICFPADNIRIRRIHSHSAFGPTYGRYMAMLLYRGEDYALVLDSHNRFVYAWDTRIVAMQLALQHPKAVLSHYPESYDETKGTEFKWERTTTAYLCRAKFLESAGYLRLIGILIDDASSFKRNARFVNPYYLPRLNLDPDVERPLPQPWAAGGFIFANASIMREVPFDLHLPHIFDGEEVMYSVRLWTHGYDIYSPKRGICYHFYGRPKEPKLWNEAKRWYTVQAHSRRRIQYFLRARVKGVDVLRVPKNTQDPVVMVDADRYGTGRLRSVEEWYEFAGADPVRYALAGRWCG

SEQ ID NO: 105 - protein, 848 aa, Artificial Sequence
  TM35_000391720-t36_1-p1
MPLESVAVPPQVIYRRSTDVFVSEHEQQAHGITTATPSVTRIPHVRDHNKNMRWRGRDHGWNNRNICSRIRDFYTDDQNVICTLFTVIVILLLLCIFLIGMCSWLLISKQEEIIVPKKASSSVKSIDKDALMDIWRLYETASRTKEEYHVRALREYLLRYKRMAEDRQREEDAGKTEKRIDVAPIDEPLAAVIPRFTAAPQQSLPEVLAALEKIMARVMEKDPMNGLEKAAVFLAKNFWRMEKTESYENKTQLTREKEALEPFDDILYLQLRRYFDTNEDDDDNDKKKKKKEFSSPWTPGEEGKIEEIINTDNKNEENEEKRKQCWHHIRSKAASVYTGRYYYPLRRFHRMRRFSVETADMTASWVNAMAYDYFEDNEEIINITPFKPPEPPSQEYLTSMKNAWKKTLELSPIASSLLTTSPEAPVFTGTLFVNLASFRDKECWPSIENMFIRSGNMFRVYFGIAEQNHESDLSCLSYDVLLPRSCMSAPSSSLSTTTNTMTGVGEGITFNNNNNNNNNNNNNNNNNNNNNNNNNNNNNNNNIDINSNDHRYGGAICFPIDNIRIRHVRSSAAFGPTYGRYISMLLYRGEDYTLVLDSHNRFVYGWDIRIIAMYVLQQHPKLVLSHYPESYIESEGDKFKFERETTAYLCKAQFLDTAGYIRLNGIVTNNPEEFNRNNQYAEPYKIEELHLNESIPRPLLQPWAAGGFLFANATIMREVPFDPHLPYIFDGEEVMYAVRLWTHGYDIHSPLRGICSHFYTRVGQPKVWFEAPRWTAVQGQSRKRIQYFLRARVKGVDVLRIPRNTQLPVVVMDADRYGVGRARSVEEWYSFAGVDPIHYTLDGRWCGN

SEQ ID NO: 106 - protein, 747 aa, Artificial Sequence
  TvY486_0200430:mRNA-p1
MSLESINPERQELRRQRSGVPLGSSTVQCSPLPVGVARSRRYIPGGLCNFIRFMIRPSNNREVNFLMVVILLFALICIVLIGMNMWLLHELGTRDKYTMPKPEVVVDVDAITGIWQLYETVLQTNKDSDKELLYQYLLKCRQKAAPHGTSMQAGSGISFGGTATRTSRSEGAGGSPSDLPRVLDELQKTIGIIAAQEPNDGLEGAASFIHNLLSFAPGGNTAGQSGDDGTADSDGVPNYLLSTAGAQTETEANAPFDDILYWQLYLFFSSGESSGATKDAHAWWERIQHTAPSVITARFYYPLRRYHNTHRFPSETPTTASLWYDAIAYDYFGNDAEPFTPPVGDAQVAGVLASNAELNTSLVSRTHSGTLFLNIASYRDPECWRTVQHAVGRAVNMFRVYVGIAEQHRSSDLSCIAYEALAPQACLAPGSSAETLAKSAGLNTAVCFPADNIRVRRITPAAANGPTYGRYMAMLLYRGEDYTLVLDSHIRFVYAWDSRLAALYIEMQHPRLVLTHYPESYNASSGSHFVYERKTTVYLCRATFIDSVGYVRLKGIVMDSADAVLYMHEEHVKDYPIPHLSLSPNVKRPLPQPWASGGFLFANGSIMREVPFDPHLPNLFDGEEVLYSVRLWTHGYDIHSPKNSTSFHIYTRGDQPKVWDNNPQWESTQRRTHKRVQFLLRSYLKGISVPRIPRETADPEVTVDVDRYGVGRARTVDDWYRFAGLDPVRYTVDGRWCGREMSRDAGG

SEQ ID NO: 107 - protein, 606 aa, Artificial Sequence
  rna_Baya_014_0750-1-p1
MFSVRRQFRKVGRAKRLRRLVLIVVVLAVVLVSVLVVAVHSLRDIHTDALVQDSGAAIVPDNPFVTATGTPPTPVWLDDKGVLHARSAKGKLEALSPLTGAGSRLSALHTHRKVSAWARLYMPSEAFEVPQWAIPEERNTLNHATIFVSIAAFRDRECAITIRNLFTQARSRHRIYVGVSDERSPTDVDCLSLLGLEDEQIARRLLWGNDAPAALYVERRSLTWADVMRDNRTIVTGGPGEAGVLHDNGTATGGAPAGVYLLPSYGEENITCLAGELETLRDEHLAKGFQRHGRGGPQQQLSSALVGCRVTSRVASPFGARGPTYGRYITSLFFSNQDYYMVIDSHSRFSLHWDAKMIVRTFLMPTRGILSHYPNGYEYGKSEGEFDKKDEMVMCKGVVLGNGMPKLGARWGPLGGRPVLQGFAAAGYMFGDAQFVLDVPFDPLLPYLFDGEEALYSARLWTAGWDHYAPGEANIFHNYARSTAPRFWNVMPAEGDHMRALSEKRALYLLRRAQPWASLASATAEMGGTRKPKEEPSYIPPELRLIVPDSEAVAEPAISAHAEYYGMGKNRSLQEYWSFVGLSDDQIKTKDSEQRWEGSDALCLNS

SEQ ID NO: 108 - protein, 505 aa, Artificial Sequence
  BSAL_53670-t42_1-p1
MQPKRRPESATVQRNSAIIVAASFLVAVGVFLFVSKSSPLQDASEEQVRPLIRTGSKRHQSNNNDAVVAPHSAHDVTSAGNDDVLPLIAEVREHLQSVRNRMQDRPGAPQVHTPLSPNSAQHLMMNQHLPIGGHNNGGEEVEDAHSTIFVSIAAFRDVECGPSLEDMFRKAKYPHRIFAGIVDQREPGEFNLCIPQSFRDCQNQPLNSSWAAAASSSDHNNNKDKTSAETWNSTKSTFCPMDNVRTRHTLPNEARGPTFGRFVAQLMYQGEQYYMMIDSHMRFVERWDVRLLSMYAKMPTRGVISHYPSGFEPGFVLESNHDIMFMCYAHFYDGVGILRNGAKNVRNRQKRPVLQPFTAAGFLFGHSDYIFDVPFDPWLDYLFDGEEILYTVRLWTSGWDSYLPSHDIMYHFYGRPKAPKVWGTTNQWVAIQRVSQRRVLHMLKMTKPNSTIPVVDPSTETETRIFNELETYGLGSVRRLEDFWPFAHVDPIKRTSDRGFCDRAN

SEQ ID NO: 109 - protein, 667 aa, Artificial Sequence
  CFAC1_090018200.1-p1
MQDFGSTPSLLKRPLRGPRRRVSGRRKALLACVGLVVLLVVFLLLGRSDETPFPPSPADNAGARGAAYTRHPAPPTDAHTTRPAAATGTKSTTTTPAPAPQSDGDKPWVTAADGNTFNALVETHAHGTAWRDRRSNAIVALARSGTVALVTPTITVRHHRDDHQRWDSLYQPNDTYRVPAWAAPADRDSLRHASIFTSLAAFRDHECATTLRDLFDMAVAPHRLYVGVSEERKPADTSCLALLGLNDADTTETRRVLYGKDAPADMSVELRSLTWADVVSPRAIVDVDSVLSGAAAVPSAPHPEGIFLHPSYAAERLSCVAGELETLRDRLRLHEDDARREAGGGTVFREGRGGPQQRPSRALAGCRVTTRVTAPELARGPTFGRYVTSLFFFDQDYFMVVDSHTRFSVHWDAKLMTRIFQLPTPGVLSYYPNGYREGHEREEYGKRDYMMMCTAQVLSNGMPKLGARWKPTGKHPVVQGFAAAGFMFGDAQYVLDTPFDPFLPYMFDGEEVLFSARMWTGGWDLYGPAESDVFHHYGRDNTPKYFGIIGGPEARRRLLAEQRTLHLLRRAHPWIQELVTRGYATPDGQVTLKPLPPVEAPETRLIVNDDMADRTREINVWKSYYGMGTQRTLAQYWEHTELSDSFVKKRDDENRWLGGESLCNGGF

SEQ ID NO: 110 - protein, 587 aa, Artificial Sequence
  EMOLV88_170014900.1-p1
MLPTAPLINSHSLEKPWVTADTDSYRLTTIIKGRVPGTAWRDTRFNAVVSLSKKGSLAYIHPPNRRRAVAKNSDAFREWDSIYQPNEKYTIPAWATPEESLTLRHATIFTSLASFRDYECALTLRNLFSMAVAPHRLYVGISEERKPSDASCLALIGARNLNMAEVRRVLYGEGAPIELSVELRNFSWEDVVHPRKLLDVDAEITLPLVNSSEKNASPPGVFVHPKHAAERLSCVAGELETTRDAFLLAENDAQRAKNGTSIFRRGRGGPQQEPSRALAGCRITTRVADSMSARGPTFGRYITSLFFFDQDYFMVIDSHTRFAVDWDVKLISRVFQMPTRGVLSYYPNGYTEKNDRAEFDKTHTMLMCTAQVLANGMPKLGARWVPFTPHPVPQGFAAAGFMFGDAQFVLDSPFDPFLPYMFDGEEILFSARMWTAGWDLYGPGQSVVFHNYDRPQTPKYFEILRMNENARRVLSELRTLYMLRRAQPWAEVLVRRGYTSPDGQSTVKPLPPVEAPETRLIVTDAAAFRKREISVWVGYYGMGSVRPISQYWEYTELTDRFVKRKDSEHRWMGGTGLCDKVTANLTQ

SEQ ID NO: 111 - protein, 638 aa, Artificial Sequence
  LAEL147_000253000.1-p1
MPDYVQVPSLLKRPLRVPRRRLSTRRRQALIAFIAILCLCALPFMYFFSTSSATALSELSHPREKPWITFDENSTRFEHIVEGRTPGTAWRDSRLNMIVSFSKSGDVVHVTPTNYVRHRRGSDDSPGAFRKWESIYRPRDRYRIPAWATPADRDALHHASIFTSLAAFRDHECALTLRNLFDMAVAPHRLYVGVSEERSPSDASCLSSIGVDNLASGETRRVLYGAEAPRTLGVEVRSLTWADVVAPRQLLDVDAVLSVPADGAAEYGAQPAGVFLHPAYAGERLTCVAGELETARDRLLLAEDDARQGMNGGSVFRRGRGGPQQQPSRALAGCRVTTRVVEPAFARGPTFGRYITSLFFFDQDYYMVVDSHTRFSVDWDMKLITRVFQLPTRGVLSHYPNGYREGHDREEFDKKMVMLMCTAQVLSNGMPKLGARWMTLSPHPVLQGFAAAGFMFGDAQFMLDTPFDPFLPYMFDGEEVLFSARMWTAGWDLYGPGQPDVFHHYGRPNTPKYFGIMTSKEAARRVLSEQRTLYMLRRAHPWIEELVRRGYVSANGQSTLKPLPLEEAPETRLIVTDEVAAETREISVWAKYYGMGTERSVSAYWQHTELSDEFVKAKDEENRWLGGFGLCQKGGAMA

SEQ ID NO: 112 - protein, 637 aa, Artificial Sequence
  LAMA_000268900.1-p1
MPDYDQVPSLLKRPLRMPRRRLSARRRQAFLVFAILCLCGPSFMYFFSTSSAKVRGELPDSREKPWITPSENSTRFAHIVDGHTPGTAWRDPRFNVIISFSKSGDVVHVTPTNHVLHRRASDDGSSVLRKWESIYHPSDKYRIPAWATPADRDTLHHASIFTSLAAFRDHECALTLRNLFDMAVAPHRLYVGVSEERSPSDASCLSSIGVDDLESGETRRVLYGAEAPRTIGVEVRSLTWASVVAPRLLLDVDAALSVPTGSTAEYGARPAGVFLHPAHAGERVICIAGELETARDRLLLAEDDAKQDMDGGSVFRHGGGGPQQQPSRALAGCRVTTRVTEPRFARGPTFGRYITSLFFFNQDYYMVVDSHTRFSVDWDMKLITRVFQLPTRGVLSHYPNGYREGNDREEFDRTIVMLMCTAQVLHNGMPKLGARWMKLSPRPVLQGFAAAGFMFGDAQFMLDTPFDPFLPYMFDGEEVLYSARMWTAGWDLYGPGQSDVFHHYGRPNTPKYFGVMTPKEAARRVLSEQRTLYMLRRAHPWVEELVRRGYVSANGQTTLKPLPPKEAPETRLIVTDEVAAETREISVWAKYYGMGTERSVSAYWQHTELSDEFVKAKDEENRWVGGVGLCEKGGAMG

SEQ ID NO: 113 - protein, 638 aa, Artificial Sequence
  LARLEM1108_170015900.1-p1
MPDYGQVPSLLKRPLRVPRRRLSTRRRQALIAFIAILCLCGLLFMYFFPTSSASALSEFSDLREKPWITSDENSTRFKHIVEGRTPGTAWRDPRFNMIVSFSKSGDVVHVTPTNYVRHRRSSDDSPGAFRKWESIYQPSDKYRIPAWATPADRDALHHASIFTSLASFRDHECALTLRNLFDMAVAPHRLYIGVSEERSPSDASCLSSIGVDNLASGEARRVLYGVEAPRTLGVEVRSLTWADVIAPRQLLDVDAVLSVPTDGAAEYGARPAGVFLHPAYAGERVTCVAGELETARDSLLLAEDDARQGMDGGSVFRRGRGGPQQQPSRALAGCRVTTRVAEPAFARGPTFGRYITSLFFFDQDYYMVVDSHTRFSVDWDMKLITRVFQLPTRGVLSHYPNGYREGHDREEFDKKIVMLMCTAQVLSNGMPKLGARWMSLSPHPVLQGFAAAGFMFGDAQFMLDTPFDPFLPYMFDGEEVLYSARMWTAGWDLYGPGQSDVFHHYGRPNTPKYFGIMTPKDAARRVLSEQRTLYMLRRAHPWIEELVRRGYVSANGQSTLKPLPLEEAPETRLIVTEEVAAETREISVWATYYGMGRERSLSAYWQHTELSDVFVKAKDEENRWLGGAGLCQKGGAMS

SEQ ID NO: 114 - protein, 638 aa, Artificial Sequence
  LbrM.17.1130:mRNA-p1
MRDYSQVPSVLKRPLRMPRRRLSVRRRQAILAVIAILCLCVLSFMYFLSTSPVNEHRKFSDIPSKPWFTAEENATRFAQVVQGRTPGTTWRDATFNMILSLSKSGDTVYMTPTNYTRYRRTTDGNPGDFRKWESIYRPGDRYHVPAWATPADRATLHHASIFVSLASFRDHECALTLRNLFDMSASPHRLYVGVSEERRSSDASCLSRLGMDDLESGETRRVLYGAEAPASLGVEVRTLTWADVLAPRRLLDVDAVLSTPAVSAEGIGVEPDGVFVHPAHAAERVLCVAGELETARDTLLIGEEDAKSAIAGQSVFRKGRGGPQQQPSRALAGCRVTTRVTDASHARGPTFGRYITSLFFFNQDYFMVVDSHTRFSVDWDMKLITRVFQLPTRGVLSNYPNGYREGHDREEFEKTDIMFMCTAQVLSNGMPKLGARWMPLSPRPVLQGFAAAGFMFGDAQFTLDTPFDPFLPYMFDGEEVLYSARMWTAGWDLYGPGQPDVFHHYSRPNTPKYFGIMTPKEAARRLLSEKRTLYLLRRAQPWMEELVHRGYVSPNGQSTLKPLPSAPPPETRLIVTDEVASATREINVWSKYYGMGAERSVSSYWQYTELSDEFVKTKDNENRWMGGIGLCEKGAALV

SEQ ID NO: 115 - protein, 638 aa, Artificial Sequence
  LdCL_170017200-t42_1-p1
MPDYGQVPNLLKRPLRMPRRRLSARRRQALIAFIAILCLCGLPFMYFFSTSSATALGELPDPREKPWITSDENSTRFEHIVHGRTPGTAWRDPRFNMIFSFSKSGDVVHVTPTNYVRHRRGSDDSPGAYRKWESIYQPSDKYRIPAWATPADRDALHHASIFTSLAAFRDHECALTLRNLFDMAVAPHRLYVGVSEERSPSDASCFSSIGVDDLASGETRRVLYGAEAPRTLGLEVRSLTWADVVAPRQLLDVDAALSVPTDGAAEYGARPAGVFLHPAHAGERVTCVAGELETARDRLLLAEDDARQGMDGGSVFRRGRGGPQQQPSRALAGCRVTTRVAEPAFARGPTFGRYITSLFFFDQDYYMVVDSHTRFSVDWDMKLITRVFQLPTRGVLSHYPNGYREGHDREEFDKKIVMLMCTAQVLSNGMPKLGARWMKLSPHPVLQGFAAAGFMFGDAQFMLDTPFDPFLPYMFDGEEVLYSARMWTAGWDLYGPGQPDVFHHYGRPNTPKYFGIMTPKEAARRVLSEQRTLYMLRRAHPWIEELVRRGYVSANGQSTLKPLPLEEAPETRLIVTDEVAAETREISVWAKYYGMGTERSVSAYWQHTELSDAFVKAKDEENRWLGGFGLCQKGGAMA

SEQ ID NO: 116 - protein, 634 aa, Artificial Sequence
  LENLEM3045_170016400.1-p1
MRDHSQVPSLLKRPLRVPRRRLSARRRQAILAAMAIVSLTVLSFTYILALSPSASAALGDPPATPWITADGNMLHFSGVIQGRTPGSAWRDASSSMIVSLSKAGDVVYTTPAKHIRHQRATDGGSGTFRKWESIYEPEVRYRIPDWATPSDRDTLQHASVFTSIAAYRDHECALTVRNLFDMAAAPHRLYVGVSEERSASDASCLSSIGIDNLASGETRRVLYGAGAPVTLAVEVRTLTWDAVLSPRPLLDVDAVTNMSAESAAEPGGVFLHPAHASERLFCVAGEVETLRDTLLLEEDDMKRASSGGSVFRRGRGGAQNQPSHALAGCRVTTRVTEHLLARGPTFGRYITSLFFFNQDYFMVVDSHTRFSVDWDAKLITRVFQLPTRGVLSNYPNGYREGHEREEFGKVDFMLMCTAQVLSNGMPKLGARWMPFSRHPVLQGFAAAGFMFGDAQFMLDAPFDPFLPYLFDGEEALYSARMWTAGWDLYGPGQADVFHHYGRLNTPKFFAVLTEQKSARRVLSERRALYLMRRAQPWIEELVRRGYVSAEGQSTSRPLPRIEAPETRLIVTDEVAAATPEIGMWAKYYGMGAERSVSAYWQHTELADEFVKEKDKEHRWVGGDGLCKRAAIATE

SEQ ID NO: 117 - protein, 637 aa, Artificial Sequence
  LGELEM452_170012100.1-p1
MPDYGQVPSLLKRPLRVPRRRLSTRRRQALIAFIASLCLCGLLMYFFSTSSASALSELSDLREKPWITSDENSTRFKHIVEGRTPGTAWRDPRFNMIVSFSKSGDVVHVTPTNYVRHRRGSDDSPGAFRKWESIYKAGDKYRIPAWATPADRDALHHASIFTSLAAFRDHECAQTLRNLFDMAVAPHRLYIGVSEERSPSDASCLSSIGVDNLASGEARRVLYGVEAPRTLGVEVRSLTWADVVAPRQLLDVDAVLSVPTDGAAEYGARPAGVFLHPAYAGERVTCVAGELETARDRLLLAEDDARQGMDSGSVFRRGRGGPQQQPSRALAGCRVTTRVAEPAFARGPTFGRYITSLFFFDQDYYMVVDSHTRFSVDWDMKLITRVFQLPTRGVLSHYPNGYREGHDREEFDRTIVMLMCTAQVLSNGMPKLGARWMSLSPHPVVQGFAAAGFMFGDAQFMLDTPFDPFLPYMFDGEEVLYSARMWTAGWDLYGPGQPDVFHHYGRPNTPKYFGIMTPKEAARRVLSEQRTLYMLRRAYPWIEELVRRGYVSANGQSTLKPLPLEEAPETRLIVTEEVAAETREISVWATYYGMGRERSLSAYWQHTELSDVFVKAKDEENRWLGGTGLCRKGGAIS

SEQ ID NO: 118 - protein, 638 aa, Artificial Sequence
  LINF_170017300-T1-p1
MPDYGQVPSLLKRPLRMPRRRLSARRRQALIAFIAILCLCGLPFMYFFSTSSATALGELPDPREKPWITSDENSTRFEHIVHGRTPGTAWRDPRFNMIFSFSKSGDVVHVTPTNYVRHRRGSDDSPGTFRKWESIYQPSDKYRIPAWATPADRDALHHASIFTSLAAFRDRECALTLRNLFDMAVAPHRLYVGVSEERSPSDASCFSSIGVDDLASGETRRVLYGAEAPRTLGLEVRSLTWADVVAPRQLLDVDAALSVPTDGVAEYGARPAGVFLHPAHAGERVTCVAGELETARDRLLLAEDDARQDMDGGSVFRRGRGGPQQQPSRALAGCRVTTRVAEPAFARGPTFGRYITSLFFFDQDYYMVVDSHTRFSVDWDMKLITRVFQLPTRGVLSHYPNGYREGHDREEFDKKIVMLMCTAQVLSNGMPKLGARWMKLSPHPVLQGFAAAGFMFGDAQFMLDTPFDPFLPYMFDGEEVLYSARMWTAGWDLYGPGQPDVFHHYGRPNTPKYFGIMTPKEAARRVLSEQRTLYMLRRAHPWIEELVRRGYVSANGQSTLKPLPLEEAPETRLIVTDEVAAETREISVWAKYYGMGTERSVSAYWQHTELSDAFVKAKDEENRWLGGFGLCQKGGAMA

SEQ ID NO: 119 - protein, 638 aa, Artificial Sequence
  LmjF.17.1020:mRNA-p1
MPDYGQVPSLLKRPLRVPRRRLSTRRRQILIAFVAILCLCGLLFMHFFSTSSSTAPSELSDLRDKPWITSDENLTRFENIVEGRTPGTAWRDPRFNMIVSFSKSGNVVHVTPTNYVRHRRGSDDSPGAFRKWESIYQASDKYRIPAWATPADRDALHHASIFTSLAAFRDHECALTLRNLFDMAVAPHRLYIGVSEERSPSDASCLSSIGVDNLASGETRRVLYGLDAPRTLGVEVRSLTWADVVAPRQLLDVDAVLSVPTDSAAGYGAQPAGVFLHPAYAGERVTCVAGELETARDRLLLAEDDVRQGMDGGSVFRRGRGGPQQQPSRALAGCRVTTRVAEPASARGPTFGRYITSLFFFDQDYYMVVDSHTRFSVDWDMKLITRVFQLPTRGVLSHYPNGYREGHDREEFDKETVMLMCTAQVLSNGMPKLGARWMSLSPHPVLQGFAAAGFMFGDAQFMLDTPFDPFLPYMFDGEEVLYSARMWTAGWDLYGPGQSDVFHHYGRPSTPKYFGIMTPKEAARRVLSEQRTLYMLRRAHPWIEVLVRRGYVSANGQLTLKPLPPVEAPETRLIVTEEVAAETREISVWATYYGMGRERSVSAYWQHTELSDVFVKVKDEENRWMGGVGLCHKGGALS

SEQ ID NO: 120 - protein, 637 aa, Artificial Sequence
  LmxM.17.1020.1-p1
MPDYGQVPSLLKRPLRMPRRRLSARRRQAFLVFAILCLCGLPFMYFFSTSSAKVRGELPDSREKPWITPSENSTRFAQIVDGRTPGTAWRDPRFNMIISFSKSGDVVHVTPTNHVLHRRASDDSSSAFRKWESIYQPSDKYRIPAWATPADRDTLHHASIFTSLAAFRDHECALTLRNLFDMAVAPHRLYVGVSEERSPSDASCLSSIGVDDLASGETRRVLYGAEAPRTIGVEVRSLTWASVVAPRLLLDVDAALSVPTGSTAEYGARPAGVFLHPAHAGERVICIAGELETARDRLLLAEDDAKQDMDGGSVFRHGGGGPQQQPSRALAGCRVTTRVTEPRFARGPTFGRYITSLFFFDQDYYMVVDSHTRFSVDWDMKLITRVFQLPTRGVLSHYPNGYREGNDREEFDRTIVMLMCTAQVLHNGMPKLGARWMKLSPHPVLQGFAAAGFMFGDAQFMLDTPFDPFLPYMFDGEEVLYSARMWTAGWDLYGPGQSDVFHHYGRPNTPKYFGVMTPKEAARRVLSEQRTLYMLRRAHPWVEELVRRGYVSANGQTTLKPLPPKEAPETRLIVTDEVAAETREISVWAKYYGMGTERSVSAYWQHTELSDEFVKAKDEENRWVGGVGLCEKGGAMG

SEQ ID NO: 121 - protein, 638 aa, Artificial Sequence
  LPMP_170990-t37_1-p1
MRDYSQVPSVLKRPLRMPRRRLSVRRRQAILAVIAILCLCVLSFMYFLSTSPVNEHRKFSDIPSKPWFTAEENATRFAQVVQGRTPGTTWRDATFNMILSLSKSGDTVYMTPTNYTRYRRTTDGNPGDFRKWESIYRPGDRYHVPAWATPADRATLHHASIFVSLASFRDHECALTLRNLFDMSASPHRLYVGVSEERRSSDASCLSRLGMDDLESGETRRVLYGAEAPASLGVEVRTLTWADVLAPRRLLDVDAVLSTPAVSAEGIGVEPDGVFVHPAHAAERVLCVAGELETARDTLLTGEEDAKSAIAGQSVFRKGRGGPQQQPSRALAGCRVTTRVTDASHARGPTFGRYITSLFFFNQDYFMVVDSHTRFSVDWDMKLITRVFQLPTRGVLSNYPNGYREGHDREEFEKTDVMFMCTAQVLSNGMPKLGARWMPLSPRPVLQGFAAAGFMFGDAQFTLDTPFDPFLPYMFDGEEVLYSARMWTAGWDLYGPGQPDVFHHYSRPNTPKYFGIMTPKEAARRLLSEKRTLYLLRRAQPWIEELVHRGYVSPNGQSTLKPLPSAPPPETRLIVTDEVASATREINVWSKYYGMGAERSVSSYWQHTELSDEFVKTKDNENRWMGGIGLCEKGAALM

SEQ ID NO: 122 - protein, 634 aa, Artificial Sequence
  LMARLEM2494_170015500.1-p1
MRDPGQIPSLLKRPLRMPRRRLSARRRQAFLVVMAIMCVCMLSFIYVLRFSADAPDVVFDTQTKPWITADGNLTHFSQIVRGHTPGTAWRDPLSNRIVALSKLGDVVYMTPTKFIRHQSPMDGGPGTFHKWESLYQPDERYHIPDWATPSDRDTLQHASIFTSLAAFRDRECALTLRNLFDMAVAPHRLYVGVSEERNSSDASCLSSIGIDDLLSGEMRRVLYGSGAPAALGVEVRTLTWEAVLAPRSLLDADAAAGQPAGTAEEPDGIFLHPAHSSERLYCVAGEAETLRDTLLLAEDDAQRTTSGGSVFRRGRGGLQQQRSRALAGCRVTTRVTEAAFARGPTFGRYITSLFFFDQDFFMVVDSHTRFSVDWDAKLITRVFQLPTRGLLSNYPNGYREGHEREEYGKRDFMLMCTAQILDNGMPKLGARWMPFTRHPVLQGFAAAGFMFGDAQFVLDTPFDPFLPYLFDGEEALYSARVWTAGWDLYGPGQPDVFHHYVRQNTPKYFDIVVAEKAARRVLSQKRALYLMRRAQPWIEELVRRGYVTAEGRSTLKPLPQVEPPETRLIVTDEVAAATPEIRVWAKYYGLGAARSVSAYWQHTELADEFVKAQDNEHRWMGGVGLCRRAGIDNA

SEQ ID NO: 123 - protein, 638 aa, Artificial Sequence
  LTRL590_000019100.1-p1
MPDYGQVPSLLKRPLRVPRRRLSTRRRQALIAFIAILCLCALPFMYFFSTSSATALSELSDPREKPWITSDENSTRFEHIVEGHTPGTAWRDPRLNMIVSFSKSGDVVHVTPTNYVRHRRGSDDSPGAFRNWESIYQPRDKYRIPAWATPADRDALHHASIFTSLAAFRDHECALTLRNLFDMAVAPHRLYVGVSEERSPSDASCLSSIGVDDLASGETRRVLYGAEAPRTLGVEVRSMTWADVVAPRQLLDVDAVLSVPTDGAAEYGARPAGVFLHPAYAGERVTCVAGELETARDRLLLAEDDARQGMDGGSVFRRGRGGPQQQPSRALAGCRVTTRVAEPKFARGPTFGRYITSLFFFDQDYYMVVDSHTRFSVDWDMKLITRVFQLPTRGVLSHYPNGYREGHDREEFDKKMVMLMCTAQVLSNGMPKLGARWMTLSPHPVLQGFAAAGFMFGDAQFMLDTPFDPFLPYMFDGEEVLYSARMWTAGWDLYGPGQPDVFHHYGRPNTPKYFGIMTPKEAARRVLSEQRTLYMLRRAHPWIEELVRRGYVSANGQLTLKPLPLEEVPETRLIVTDEVAAETREISVWAKYYGMGTERSVSAYWQHTELSDEFVKAKDEENRWLGGFGLCRKGGAMA

SEQ ID NO: 124 - protein, 638 aa, Artificial Sequence
  LTULEM423_170015700.1-p1
MPDYGQVPSLLKRPLRVPRRRLSTRRRQALIAFIAILCLCGLLFMYFFSTSSESALSKLSDLSEKPWITSDENSTRFKHIVEGRTPGTAWRDPRFNMIVSFSKSGDVVHMTPTNYARHRRSSDDSPGAFRKWESIYQPSDKYRIPAWATPADRDALHHASIFTSLASFRDHECALTLRNLFDMAVAPHRLYIGVSEERSPSDASCLSSIGVDNLASGEARRVLYGVEAPHTLGVEVRSLTWADVIAPRQLLDVDAVLSVPTDGAAEHDARPAGVFLHPAYAGERVTCVAGELETARDRLLLAEDDARKGMDGGSVFRRGRGGPQQQPSRALAGCRVTTRVAEPGFARGPTFGRYITSLFFFDQDYYMVVDSHTRFSVDWDMKLITRVFQLPTRGVLSHYPNGYREGHDREEFDKKLVMLMCTAQVLSNGMPKLGARWMSFSPHPVLQGFAAAGFMFGDAQFMLDTPFDPFLPYMFDGEEVLYSARMWTAGWDLYGPGQPDVFHHYGRPNTPKYFGIMTPKDAARRVLSEQRTLYMLRRAHPWIEELVRRGYVSANGQSTLKPLPLEEAPETRLIVTEEVAVETREISVWATYYGMGRERSLSAYWQHTELSDVFVKAKDEENRWLGGTGLCQKGGAIS

SEQ ID NO: 125 - protein, 552 aa, Artificial Sequence
  PCON_0046770.mRNA-p1
MPPGQFRSGIRAHGGILRRRRISVLLMLLCCSLLASFVAFRLLIRGESVDGSAVLVSLRTDGSSKAVRKPTVTVPRSQTPTAASTVVPSTVAATPTDGTVPPMDTATDAGTTGPPPSPEAEVETVMLKVHAAVKLPSKMFPNPIFKADPMQGTIFVLLASFRDVECVDTMENLFTTAKIPSRVFVGANEERFAKDELVPSCIPPRLLSQFRGTVHEFDWPEFVARNITPARVQCVVFEAFDKGTSTTSSPPSGSVETPLAAGGAVNGTPPATLPPFPLSRCQIVTRVASPTGARGPTYSRYVSSHLFQQQDYAMVIDSHSQFIDSWDVEMITTAALMPTKGVLSHYPNGYEPNATVNPDQGKHVMQMCRGQVLSNGIPKLGAHWIKAQAQPVLQSMVAAGYFFGSAQFIRDVPFDPHLPFLFDGEEILYTLRLWSHGWDSYCPGRELIRHHYGREKSPRFWGIMKPMDYQLRNQAEMRTKHFLQLRKINTTELLVPPEQQSEAVRVEENIYGMGSMRPVLEEYWVFAGLNHARLTTLDSEGRWIGGSELCLP

SEQ ID NO: 126 - protein, 500 aa, Artificial Sequence
  Tbg972.5.3320:mRNA-p1
MERGGKFAAIFVGHFVSRRHKVFLFLFSLLFFFTSVMLLSSCFLLSTPSFFSTGTSEGSSISRGIVSFSSGELPSSNVAADTATIFVSLASFRDNECVTTLDRLLSAAKNPHRVFVGISEERFGSESGCTNSPTLLGFVGSQRDFNIRWRDVVPRAFDEATSDEFRPPPTTPLLHARRENDVLTCFLKPKISRPSPLPQGKELLRNCQVVTRFGDPDDARGPTYARYITSLFYVDQDYYMVIDSHIRALLEWDEKMIKHARLMPTRGVLSHYPNGYTPQNPDKEVNYTHVMAMCKAVIPPTNIPKLGARWILKRQRPLLQSLVAAGYIFGDAQFVKDVPFDPYLPYLFEGEEMLYTARLWTNGWDSYCPGDSFVFHNYERASAPRFWSAIYKSNQSESRKRQEKIGVLRALYLMERKELNTTVPLVSRDVAQIVCPAISIEEGRFGMGTVRPLDAFWEFAELTDAFLKEKDDEGRWMGGEGLCHQLEALSASIKHMASED

SEQ ID NO: 127 - protein, 499 aa, Artificial Sequence
  TcIL3000_5_2160.1-p1
MHKGRCASVTSALVSAPRRWRIYTFVLAIILSLTLVLTVLVYYTLSPKGFHIASPLQRVSDMPPYVTFPSSKLPSANVSIDLATIFVSIASFRDDECASTVESILRNAKNASRVYIGISEERLQTDKSCLSAPVLSERIGVNQILRFRWSDIVPSAFWGAEIVGKQPPPTPILHAGRDEDVLSCVLMPGISQLAVHETGGDILHNCQIITRVGDPDDARGPTYARYLSSLLYGGQNYYMVIDSHTRVVPSWDVKMIERARLMPTRGVLSHYPNGYTPQNPDKELNYPNIMAMCKAVIPSTGVPKLGAHWILKSYRPLLQFFVAAGYIFGDAQFVKDVPFDPYLPYLFEGEEMLYTARLWTSGWDSYCPGDSFAFHNYERPGVPRFWTVIYDSDERQERAREEKIGTLRALYLMRRNVLNSTTPLVSHEVSHNLYPAISFEEERFGMGSERPLPLFWKLSQLSDEFVKAKDSEGRWVGGDQWCSRLEAMSLSLKSKASKG

SEQ ID NO: 128 - protein, 500 aa, Artificial Sequence
  TevSTIB805.5.2740-t26_1-p1
MERGGKFAAIFVGHFVSRRHKVFLFLFSLLFFFTSVMLLSSCFLLSTPSFFSTGTSEGSSISRGIVSFSSGELPSSNVAADTATIFVSLASFRDNECVTTLDRLLSAAKNPHRVFVGISEERFGSESGCTNSPTLLGFVGSQRDFNIRWRDVVPRAFDEATSDEFRPPPTTPLLHARRENDVLTCFLKPKISRPSPLPQGKELLRNCQVVTRVGDPDDARGPTYARYITSLFYVDQDYYMVIDSHIRALLEWDEKMIKHARLMPTRGVLSHYPNGYTPQNPDKEVNYTHVMAMCKAVIPPTNIPKLGARWILKRQRPLLQSLVAAGYIFGDAQFVKDVPFDPYLPYLFEGEEMLYTARLWTNGWDSYCPGDSFVFHNYERASAPRFWSAIYKSNQSESRKRQEKIGVLRALYLMERKELNTTVPLVSRDVAQIVCPAISIEEGRFGMGTVRPLDAFWEFAELTDAFLKEKDDEGRWMGGEGLCHQLEALSASIKHMASED

SEQ ID NO: 129 - protein, 477 aa, Artificial Sequence
  DQ04_01951010-t26_1-p1
MDRRRYHGPAGGHRTRARITIALICFASVGIISLVALMLSVLVPSPPPQAAQSPTDTKEGPQLRAVELPAAMVPVDEATIFVSIAAFRDNECVTTLESLLTRSKNQHRVFLGISEERHPTDKSCLEAPHVLNRFALTHTRTMRWKDVVPAAFVSRDSHATPVYTPLLHARRDDDVITCIQSSDAAADESRQPGLHPLSGCRIVSRLGNPDDARGPTYGRYLTSLLYNNQDYYMVVDSHSRFVPGWDVKMIERARLMPTRGVMSHYPNGYVPENPDGEADKKFVMSMCKGVILPNNIPKLGARWIPLQSSPKLQGFVAAGYIFGDAQFVKDVPFDPYLPYLFDGEEILYSARLWTNGWDSYSPGDAFLYHNYARKDAPRFWSVMQGGDVHGGRMLQQRTAIRRALYLLKRRELNTTRFIVSEEEAHSLKPEIGCDDQYFGAGKVRSLDDYWRFTQLSDEYVKEKDNEGRWMGGEGLCN

SEQ ID NO: 130 - protein, 469 aa, Artificial Sequence
  TRSC58_05317-t26_1-p1
MNRKRFERPWKFRRGGRESRRLMRACIFCVAFFILLVFGAGGYYATFERETLIVPRGTVPVFSSENLPAARIPVDIATIFVSIAAFRDKECITTLESLFTRAKYPRRVFLGISEERFETDVSCINSPKVLNSIDVNRSRTMRWKDLIPSAYDAASQQKHPKPTPVLHERRDEDIITCLLSADASDAPTSPGESMLNGCQVVTRHGHPDDARGPTYGRYITSLFYNNQDYYMVIDSHSRFVPDWDVKMIERARLMPTRGVLSHYPNGYTPEAPDAEINKSDVMCMCKGVILPDNIPKLGARWIAIRGHPVLQGFVAAGYIFGDAQFVRDVPFDPYLPFLFDGEEILYTVRLWTHGWDSYSPATALVYHNYMRVDAPRFFSVISRPGTKERRELERQTAIQRVLYFLKRRVLNTTQLVVTDDEAHRQNPAIVREEAHFGMGSLRSLADYWEFVELSDAFVKEKDDEGRWMG

SEQ ID NO: 131 - protein, 485 aa, Artificial Sequence
  TM35_000201600-t36_1-p1
MKRFEKLGKIQRHRKRLVFLILLSLSIFICMALFLLISGMALQYNSEEGQSRMGKGSAVFGKMEGNVFSSHNLPSASKSVEEATIFLSIAAFRDVECVTTVESALTRARFPHRVFIGISEERYENDESCINLTDTLQRMNMTRTRTLRWKDVVPSAFETEKNAESKSKPTPLLHPGRSNDLITCLLSPHAASRTLDSTNTSVLDGCQIITRVGEPDDARGPTYARYITSLFFNNQDYYMVVDSHSRFIPDWDIKMIERARLMPTRGVMSHYPNGYTPENPDKEITKLDVMSMCKGVIMPNNIPKLGARWIPIQSKPVLQGFVAAGYIFGDSQFVRDVPFDPYLPYLFDGEEILYTARLYTSGWDSYCPGSALLYHNYERHKAPRYFAVIVRDEVRAHRLLQQRTAIRRVLYLLRRCQLNTTNRIVTDDEAHVLNPAIGQYEKFFGMGKVRSLHSYWHFTQLSDEFIKSKDNEGRWMGGEGLCEIK

SEQ ID NO: 132 - protein, 488 aa, Artificial Sequence
  TvY486_0501730:mRNA-p1
MRTEVYRRLRGGVAFRSSRFKRGLQLAYLLIGVLVAVLLLVLLLSNRVMATLAGGGRSKRDGGWSSSRYIPFPASKLPAANVPIGVATIFVSIASFRDVECLTTVESLLTQANNSHRIFLGISEERFGHEPSCVNAPLIFKAIGIERNRTLRWRDVVPSAFVERSKKHPPPPMPILHAGRDTDLLTCYVSKSATMLHEGKQVGALKGCQIVTRVGDPDDARGPTYGRYLTSVMYTGQDYYLVVDSHTRVVPDWDSKMIRFARLMPTRGVLSHYPNGYTPQDPDKELSKDDIMSMCTGVIPPTNIPKLGAQWVKKRDHPFLQSFVAAGFIFGDAQFVKDVPFDPYLPYLFEGEEILYTTRLWTSGWDSYCPGDAFLYHNYDRPKAPRFWSVVYNSKMKEQRMYEERIASMRVLYLTRRHKLNSTVLEVSHADAHKTHPAVGYEEERFGMGHLRPIHEYWKFAELSDEFTVAKDNEGRWTGGRGLCNRAV

SEQ ID NO: 133 - protein, 758 aa, Artificial Sequence
  rna_Baya_228_0080-1-p1
MYADLHGVVLNETDLAYRLHSIGRDPLEGSILLDEHLQYNEHALPFSNTTPPQNVLSSYYGNNNGYLARLNHLAENRLESDGYTNRTMFSEAFWDPIHLTRRGYGLEGSIFVGLIHNHRNIGFWIQELTNASNINLDEDGINPYEMCSATIESIFKNAQWPVGVFVGVVELLIVPPDSTSNSLDNVHTSSYSCVPPEFESARQQESLGFSYADNLRVRRVPFSMNVDIPGATKPGNPWYLPYSSASAVRAATLNLYNGESYIMFLETGSHMVPDWDWRLRLMYLQLPSAERAIISTKPLQNISIVWSSLVHVAVNAHGNPNIKVSDGEQRIILPSGTLPPDPERQNDDTLLGAEASLRFSAVVKLLKVDPWSAIRFALPFWLHPLLGKCCEGSETAPFASAGSVLQELRRSLMMNETEHNFYQSSLFAMSRESLSKTEVLSLLYLSRLSSNDQPVTTSEERQTLLVQCEKFMDEARQLLLKKEYEKCWLLEHRDVIRKAVSMGFGATLEVPLLSIAPLDMANGVTGALNQSFRVSTHTSARLTDTLQDAKFMRADVQSLLTESSANKLPDEAEFGNSPYSNGNGVPFLLQGVASAAFMFSRAEVFFDIPPELQLRVSAEHTNNFCPSPLHLDPYYSFLTDDEADLHLSASLWGRGWNIFAPVEPVLFSVDSAISANRNLSHSIPKPILQFRRATVSRLQKVFSSNTQETDAEGCGKGGVYGLGTVRDFGEFCSRTGFSLGDQLNLWRLEEEELRRSLG

SEQ ID NO: 134 - protein, 1125 aa, Artificial Sequence
  CFAC1_160013300.1-p1
MRLKASLLPGHRSRTSRVARRVMIAVLFLIVLLVACLGYMVYHSLGDGNGIFPLETLPVTDPSQPNRGGAHGGLTFPPSPERDAHAEGAMPYSESLNELVQLLKLYTATRGVAVNTTQLRLPTPSGGGAGGDDLPAELQLAGLRELYANASMIPPAGAGRTWMLDDPAVIQTEQEDYVERFIAPVQSDESLTPLRVLSAYYDPQSPRSLHHLAAATEKSANDDGYAAYIQRSPTFYDPAHAARRGYGAEGSIFVGVPFTLSDITADMIAAITARATAPFVKKEEPAVEADARRSPLDGGDDAASVRDTDGFREVHRTAARCAVTVESLLRHAHHASAITVGTIDVVVVSGVTSAEETDLAMPADVRLPITLEERQNLTAKPTRHYDRITCEPPDFRSGWGDASYGFYWRDNMRQRRVTVPLMQLASADARTGVPRPSFLDGAQVGRYAVLQLYRGESYVFLLRPGSLALPRWDLKLRLLYLRTPQHQRAVLSSRPTPAVLPQALAAVTIKTWAAHPVLPFGLLTSAAAEGAGGGAGIVTDPAAAAAATTNTPATDWMYQRLLATLPTDVAAWLGEAHAEAPLALWLVTPRWLWPTVLSALSEWRKMTNNTAASPPLRPSLQDLFGEEAVQTFLGPATSGTAVLDVASSVTVADAPVSATEPNAPAKVLLSGVGAQTRTPQSVLETSLTPAEVAKLVFLHEKRAPLPNEPIVDMKELLVENASVETVSPAAAAAAVTGGPIPCGTTGTPLAFYSTAHKALVKRAFEFCWLQRHRDKLRPLAVRLARSARPLTVLTTSATTGEAAPPPAGDVKCGGNEDANGLAWYATTVADRVKASHCLSDMRYLDPSDPPLLDADGTAPVSLKSWFVASGNAGQVRGSSALPARLNAAAAEVNADARATAIATNTAAGGEPQTAATAATPYVLQSAASADLLFAPAEAFFPISPEDRLRTRAQSLEAQLRQRKAANGTGTNGTSAAQSDYAETPEPIVLDPSLHYLDSGSLDLYVTTALWTRGWNVFGLTEAVIAGDAVPTSTTTTEAEVCKIGGGGAAASVVVPEVVAAAQAFGQEKLWAVLAAHRAAGTPVGPLMASENELNTTAMVARFPLRRTLSDFEAFARVKLDDLRPK

SEQ ID NO: 135 - protein, 1109 aa, Artificial Sequence
  EMOLV88_020005600.1-p1
MRLWSLSSRRCRTRRLKRFIFIFIFVFILLLTFWLSTFEVTVSHKNAVGGPSANFPSSDRPNRSGGAGENGDAQALPEKSIEVPYGESLEELLQLLRVYAAYRGVRVNHTYLAPTKATAAADAGYKVDNSTRESKGRGLSLELSGMELLHGLLGDHDHLWANWSLEAPEKIMDEHEVYVEQFIAPTRVDDEITPLRVISSHYSTQSIQGGLDGIAANTEKAMNDDGYAEHTQRSPGFFDVSHAARRGYGQEGSIFVAVPFSLADITAEMIDTIRQRSTTSGNVSQAPKATATERPPNADDFVGDDGFTEWRFTAARCAMTVSSLFSQAHRGVAVTVGTIDVVVVSGVASLREVEWDRPADALFPLRATERSSLTPSRHRRYSRITCEPPEFAGGLGDASEGFHWKDNLRRRRVVVPLPRLESASPAAAAALEQSFAFPYVGRYAALRLYRGESYIFFLRTGALALPNWDLMLRLLYLRTPARNRGVLTSRPTPGVVWRALAAALAKTWITEPLLPLSLTTAVRGRGGEGKVGAPATTPDEAGNRLLAALPAEVSSWLSAARVEAELVLWLVTPGWLWPTMLETLEDWRHLAAAPTSSPPATAPPALSSLFSRSAVRDLLGEKPTAPPDVDVGTLRVDHVMGAHGGAAAAASRKGQPVVQVRGGKGAATGGVSQSFLSASLTASEVYESVFLPTSGRSTPSYPTVDMAHAASTRSAAPSRGFDGAAKTLCGEQRSAAPYYSAADKMLLKRSFEYCWLMRHIQVVRQHVHRLLNATEATTLLRVFSGTQAAANFSTEVQFAESVLRPRSSSCLADMRYLEPVEGFGLAGIGRGAGKDDKNTLSDQHALDPQSTPRETDWLVSAVDVGKVHGVPTAERLKRTAGDDRLLRVNATQPTEDTLSSLTQPTPYIVQAAASADLLFGPAEAFFHFRPEHQLRTRARSLSEHLEDRRLYREKVSSTATHARVPEAVELDASLQFLDGDAEDIYMTQALWTRGWNLFGLTEPVAVNIGEDGLHTPSSTAPPPAGDGGQRRLRTSVRDVPSVLQKARAFTDHKLWALLMSHRNAGTVLGATEGSSETATPYSFRRTIKDWELFARVQLTILNETLRRWQ

SEQ ID NO: 136 - protein, 1107 aa, Artificial Sequence
  LAEL147_000030300.1-p1
MWRTVRDRGEGAKVGGKATEHPSAPGNPTVSLVPGAGADGDAPLLGGDRGAAPYTESLEDLVRLLRIYAEHRGVRVNHTYDALPAAIAAAAGLTDSGENSQTGAGARVGGLQLPGAELLHGLYGDGGQAGGHLSANWVLDEPEMITAEQETYVERYLVPTQAEVELTPLRVISSYYDTQGSRSLHRMAAETEKAMNGDGYATYIQRSRTFYDVSHAARRGYGQEGSIFVAVPFTLTDITAEMVATIRRRASTVPTSSQAQKPASSSPLEGRDDGFHELRFTAARCAMTVESLFRQAHRGVAVTVGTLDVVTVSGVSSAAELDFSKPADVTFPLRAEDRAGLPHTRRYSRITCEPPDFASGWDDASYGFRWKDNLRRRRVVVPLTQLDAASAAQADLLHGDGAAAALERYFAFPHVGHYATLQLYRGESYVFFLRTGSLALPNWDLTLRLLYLRTPARDRAVLSSRPTPRVAWTALAASVAKMWDTEPFLRLSLATASRQRNGEDATGDDMGVVATAPPPDKMGRRLLAALPADVSSWLIAARTEAELVLWLVTPSWLWPTMVETLADVRQLAASPDSPPPATASSALRLLFASDAVRGVLGNGLSTLMQADLNTVQVDPVRRSEGAAAAAASPRGQRVVSLRGGKSPTTNSTSQALLSASLTASEVYELLLLAEKRPPMQEQPVVRVPQSDPTIKWVPSSDSGAAAERLCGEATSEAPYYSAADKALLKRSFEYCWLKGHRRAVRQQLNRLVHATTAATVLKATPGTKASAAGAAAAAKCSRKRGFVEAEVVPRSSVCLADMRYLEPMEATWLTGAGGGALGDGDSANREWHATDPRSPGHENAWFTSAASVGKVHGVATASSLVSQAADGTEEPQLNSPRSPKDAASTPVESTPYVLQAVASSDLLFGPAEVFFEFDTEHQLRTGARSLSEQLAERRLHRQGLTATAAHARVPEAVELDPSLQFMDSDLEDVYMTQALWTRGWNIFGLTEPVAVGTGEEELSSSASATAPTSSSARDDGPCTVDEAADGVPSELRNARTFTQDKFWALVMAHRDAGTLLGATAVTNHSSTPPESSPPLYPLRRTMKEWELFAGMQLTTLRDALRSP

SEQ ID NO: 137 - protein, 1095 aa, Artificial Sequence
  LAMA_000036200.1-p1
MRDGGEDAKAGGKATQHPSTPGTPTVSLLPGAGAEGDARSFGGDGGVAPYTESLEELVQLLRIYAEHRGVRVNHTYDALPAGLTDSGESSQRGAGAKVAGLQLPGAELLHGLYGDDGQAGGHLSANWVLDEPETIMAEQEAYVERYLVPTQAEVEVTPLGVISSYYDMQGSRSLHRMAAETEKAMNDDGYATYILRSRTFYDVSHAARRGYGQEGSIFVAVPFTLTDITAEMVDTIRRRASAVPTSSPAQRSTSSSPLEERDDGFHELRLTAARCAMTVGSLFRQAHRGVAVTVGTLDVVTVSGVSSAAELDFAKASDVVFPLRPEDRAGVPYTRRYSRITCEPPDFASGWDDASYGFHWKDNLRRRRVVVPLTRLADASAAHAGLLRGDGAAATLERHFDFPYVGRYATLQLYRGESYVFFLRTGSLVLPNWDLTLRLLYLRTPARDRAVLSSRPTPRVAWTALSASIAKVCDTKPFLPLSLTLTSRQRNRENATGGDTDVVTTAPPPEKMGMDLLAALPADVSSWLTAARSEAELVLWLVTPRWLWPTMVETLADWRQLASSPDSPPPASASSALRVLFASDAVRDVLGNEPSTLMQADLSTVQVSPVRRSDGATAVAASPHGQRVVSLRGGRSPTTNSTSQAVLSASLTASEVYELLFLDEKRGPMPGQPIVHMPQSEPTIGQVPSRDSGAAAVRLCGEATSETPYYSAADKALRKRSFEYCWLRAHRGAVREQLNRLVHSTKAVTVLKAAAGTKAPAAGAAAQCSSKRRLLEAAMVPRSSVCLADMRYLEPMEETRLTGAGGGTLGHGDSAHQEWHAADQRSLREENAWLTSAANVGKVHGVATSSLLVSQGADGTEKPQLNSPRSPKDAPPIPVESTPYVLQAVASSDLLFGPAEAFFEFGTEHQLRTGARSLSEQLAERRLHRQGLTATAAHARVPEAVELDPSLQFMDSDLEDVYMTQALWTRGWNIFGLTEPVAVGTGEEELSSSATEAAPRSSPARDDGKCAVDGATDGVPSELRNAHTFTQDKFWGLVMAHRDAGTLLGATDARNYTTTPRGSSPPLYPLRRTMKEWELFAGMQLTTLRDALRSP

SEQ ID NO: 138 - protein, 1107 aa, Artificial Sequence
  LARLEM1108_020007200.1-p1
MWRTMHGRDEDAKVGGKATQHPSTPGNPTVSPAPGAGADGDAPPLGGDRGADPYTGSLEELVWLLRIYAAHRGVRVNHTYDALPAGIAAAAGLSDSGKNSQRGVGARVAGLQFPGVELLHGLYGDGGQAGGHLSANWVLDEPEMITAEQEAYVERYLVPAQAEVELTPLRVISSYYSMQGSRSLHRMAADTERAMNSDGYATYIQRSRTFYDVSHAARRGYGQEGSIFVAVPFTLTDITAEMVDTIRRRASTVRTSSQAQKPASSSPLEGKDVGFHELRFTAARCAMTVESLFRQAHRGVAVTVGTLDVVTVSGVSSAAELDFPKPSDVTFPLRAEDRAGLPHTRRYSRITCEPPDFASGWDDASYGFRWKDNLRRRRVVVPLAQLDAASAAQADLLHVDGAAAALERYFAFPYVGHYATLQLYRGESYVFFLRTGSLALPNWDLKLRLLYLRTPARNRAVLSSRPTPRVAWTALAASVAKMWDTEPFLRLSLATASRQRNGEDATGDDMDVVTTTPPPDKMGRRLLAALPADVSSWLNAARTEAELVLWLVTPSWLWPTMVEALADMRQLAASPDSPPPATASSALRLLFASDAVRGVLGNGLSTLMRADLNTVQVDPVRRSEGAAAAVASPRGQRVVSLRGGKSPTTNSTSQAVLSASLTASEVYELLFLAEKRPPMQEQPVVRMSQSEPTIKWVPSSDSGAAAERLCGETTSEAPYYSAADKALLKRSFEYCWLKRHRRAVRQQLNRLVHATTAATVLKATPGTKASAAGAAAAAKCSKKRGFVEAEVVPRSSVCLADMRYLEPMEATWLRGAGGGTLGDGDSANREWHAADPRSPRQENSWFTSAANVGKAHGVATASSLVSQAADGIEEPQLNSPRSPKDAASTPVEPTPYVLQAVASSDLLFGPAEVFFEFDTEHQLRTGARSLSEQLAERRLHRQGLTATAAHARVPEAVELDPSLQFMDSDLEDVYMTQALWTRGWNIFGLTEPVAVGTGEEELSSSASATAPTSSSARDDGPCTVDKAADGVPSELSNARTFTQDKFWALVMAHRDAGTLLGATAARNHSFTPPESSPSLYPLRRTMKEWEMFAGMQLTTLRDALRTP

SEQ ID NO: 139 - protein, 1151 aa, Artificial Sequence
  LbrM.02.0280:mRNA-p1
MRSRLLPSRRSRPARFARCIALCLALSIGALVLFSGLFLWKMFSDEVEGARTGSKMPQRPSMPGHPAGSSVPDAGADGVVQPLADNREAAPYTESLEELLRLLRIYAEHRGVRVNSTYHVPLEALTAALGLRGGGDSSQRGAEARGADLQLPGAELLHSLYGNGGQAGDHLFANWVLDDPETITTEQEAYVERYLVPTQAEVDLTTLRVISSYYNTQSSRGLDRMAAETEKAMNDDGYATYVQHSPSFYDVSHASRRGYGQEGSIFVAVPFTLSDITEEMIDTIRRRASAASALSQTPATPSSAPLQGRVESVGGGGFEELRLTAARCAMTVESLFRQAHRGVAVTIGTIDVVAVSGVSSATELNIEKPADVLFPLRTADRAKLTPSHKRRYSRITCEPPDFASGWDDADYGFRWKDNLRRRRVVVPLAGLDDAAAAHSSLPRRADTAAALERGFALRHVGRYATLQLYRGESYIFFLRAGSLALPNWDLTLRLLYLRTPARDRAVLSSRPTPGVTWRALAASVANVWSTEPLLRLSLTTAPRGRHSEDGFGGEREAAASVPPPDKVGERLLAALPADVSSWLSAARAEAELVLWLVTPSWLWPTMVETLADWRQLAASPDLPASATASSVLGLLFTSAAVRGVLGDAILDLSDADLRAVQVDTLANCDGDAPTKASPCGQGMVYVRSGKNSSTSRTPQAVLSASLTASEVYELLFLAEKRPPMPAQPIVHMPPSASTTTPAPFRESGAAAGRLCGEEESEAPYYSAADKALRKRSFEHCWLKEHRGAVRQQVRRLVHSTNASTVLQASSGMQAPAAGAAAAAKCHAKGSFVKAEVMPRSSVCLADMRYLEPMEGTWLTSADGGTLGSGDRAPQAHHAADEHSPLQESAWLASGANVGKVKGVATSARNAQASGRVDELQFNSPQSPGDAASATVEPTPYVLQAVASADLLFGPAEVFFEFDREHQLQTRVRSLSEQLEERRLHHQGLTATAAHARVPEAVELDPSLQFMDSDLEDMHTTLALWTRGWNVFGLTEPVAVGTGESELPTSMPATAPAASGAGHDGQCLVDEAADGVPTELSNARTFTQDKFWALVMSHRDAGTPLGSTKERNQTPTPRASSPSPYPLRRTMKEWELFAGVDLTVLHDALRSP

SEQ ID NO: 140 - protein, 1145 aa, Artificial Sequence
  LdCL_020007600-t42_1-p1
MRPRLLPSRRSRTARSAHRTLLCLVLSVGALVLLSGVVVWRTMRDGGEGAKVGGKATQHPSTPGNPTVSLVPGAGADGDAPPLGGDREAAPYTESLEELVRLLRIYAEHRGVRVNHTHDALLAGIAAAAGLTDSGENSQRGAGTRVAGLQLPGVELLHGLYGDGDQAGGHLSVNWVLDEPEAITAEQETYVERYLVPTQAEVELTPLRVISSYYNMQGSRSLHRMAAETEKAMNDDGYATYIQRSRTFYDVSHAARRGYGQEGSIFVAVPFTLTDITAEMVGTIRRRASAVPTSSQAQKPASNSPLEGRDDGFHELRLTAVRCAMTVESLFRQAHRGVAVTVGTIDVVTVSGVSSAAELDFSKPSDVTFPLRAEDRAGLPHTRRYSRITCEPPDFASGWDDASYGFRWKDNLRRRRVVVPLTQLDAASAAHADLLHGDGAAAALERYFAFPYVGHYATLQLYRGESYVFFLRTGSLALPNWDLTLRLLYLRTPTRDRAVLSSRPTPRVAWTALAASVAKMWDTEPFLRLSLATASRQRNGEDATGDDMDVVTTAPPPDKMGRRLLAALPAEVSSWLIAARKEAELVLWLVTPSWLWPTMVETLADGRQLAASPDSPPPATAPSALRLLFTSDAVSGVLGNGLPTLMQADLNTVQVDPVRRSEGAAAAAASPREQRVVSLRGGKSPTTNSTPQAVLSASLTASEVYELLFLAEKRPPMPEQPVAHMPQSEPMIKWVPSSDSGAAAERLCGEATSEAPYYSAADKALLKRSFEYCWLKRHRRAVRQQLNRLVHATMAATVLKATPGTKASAAAGAAAAKCSTKRGFVEAEVVPRSSVCLADMRYLEPMEGTWLTGAGGGTLGSGDSAHQEWHATDPRSLPEEDAWFTSPANVGKVHGVATASLLAAQTADGTEEPQLNSPRSPKDAASTPVEPTPYVLQAVASSDLLFGPAEAFFEFDTEHQLRTGARSLSEQLAERRLHRQGQAATAAHARVPEAVELDPSLQFMDSDLEDVYMTQALWTRGWNIFGLTEPVAVGTGEEELSSSPPATAPTSSSARDDGPCTVDEAAAGVPSELNDARTFTQDKFWALVMAHRDAGTLFGATAARNHSSTPPESSPPLYPLRRTMKEWELFAGMQLTTLRDALRSP

SEQ ID NO: 141 - protein, 1103 aa, Artificial Sequence
  LGELEM452_020006900.1-p1
MHGRGEDAKVDGKATQHPSTPGNPTVSLAPGAGADGDAPPLGGDRGADPYTGSLEELVRLLRIYAAHRGVRVNHTYDALPAGIAAAAGLSDSGKNSQRGAGARVADLQLPGVELLHGLYGDGGQAGGHLSANWVLDEPEMITAEQEAYVERYLVPTQAEVELTPLRVISSYYSMQGSRSLHRMAADTEKAMNGDGYATYIQRSRTFYDVSHAARRGYGQEGSIFVAVPFTLTDITAEMVDTIRRRASTVRTSSQAQKPASSSPLEGRDDGFHELRFTAARCAMTVESLFRQAHRGVAVTVGTLDVVTVSGVSSAAELDFSKPSDVTFPLRAEDRAGLPHTRRYSRITCEPPDFASGWDDASYGFRWKDNLRRRRVVVPLTQLDAASAAQADLLHVDGAAAALERYFAFPYVGHYATLQLYRGESYVFFLRTGSLALPNWDLKLRLLYLRTPARNRAVLSSRPTPRVAWTALAASVAKMWDTEPFLRLSLATASRQRNGEDATGDDMDVVTTAPPPDKMGRRLLAALPADVSSWLIAARTEAELVLWLVTPSWLWPTMVETLADVRQLAASPDSPPPATASSALRLLFASDAVRGVLGNGLSTLMRADLNTVQVDPVRRSEGAAAAAASPCGQRVVSLRGGKSPTTNSTSQAVLSASLTASEVYELLFLAEKRPPMQEQPVIRTPQSEPTIKWVPSSDSGAAAERLCGEATSEAPYYSAADKALLKRSFEYCWLKGHRRAVRQQLNRLVHATTAATVLKATPGTKASAAGAAAAAKCSRKRGFVEAEVVPRSSVCLADMRYLEPMEATWLTGAGGGTLGNGDSANREWHAADPRSPRQENSWFTSAANVGKVHGVATASSLVSQAAGGTEEPQLNSPRSPKDAASTPVEPTPYVLQAVASSDLLFGPAEVFFEFDTEHQLRTGARSLSEQLAERRLHRQGLTATAAHARVPEAVELDPSLQFMDSDLEDVYMTQALWTRGWNIFGLTEPVAVGTGEEELSSSASAAAPTSSSARDDGPCTVDEAADGVPSELSNARNFTQDKFWALVMAHRDAGTLLGATAARNHSSTPPESSPPLYPLRRTMKEWELFAGMQLTTLRDALRTP

SEQ ID NO: 142 - protein, 1146 aa, Artificial Sequence
  LINF_020007500-T1-p1
MRPRLLPSRRSRTARSAHRTLLCLVLSVGALVLLSGVVVWRTMRDRGEGAKVGGKATQHPSTPGNPTVSLVPGAGADGDAPPLGGDRGAAPYTESLEELVRLLRIYAEHRGVRVNHTHDALLAGIAAAAGLTDSGENSQRGAGTRVAGLQLPGVELLHGLYGDGDQAGGHLSVNWVLDEPEAITAEQETYVERYLVPTQAEVELTPLRVISSYYNMQGSRSLHRMAAETEKAMNDDGYATYIQRSRTFYDVSHAARRGYGQEGSIFVAVPFTLTDITAEMVGTIRRRASAVPTSSQAQKPASNSPLEGRDDGFHELRLTAVRCAMTVESLFRQAHRGVAVTVGTIDVVTVSGVSSAAELDFSKPSDVTFPLRAEDRAGLPHTRRYSRITCEPPDFASGWDDASYGFRWKDNLRRRRVVVPLTQLDAASAAHADLLHGDGAAAALERHFAFPYVGHYATLQLYRGESYVFFLRTGSLALPNWDLTLRLLYLRTPTRDRAVLSSRPTPRVAWTALAASVAKMWDTEPFLRLSLATASRQRNGEDATGDDMDVVTTAPPPDKMGRRLLAALPAEVSSWLIAARKEAELVLWLVTPSWLWPTMVETLADGRQLAASPDSPPPATAPSALRLLFTSDAVSGVLGNGLPTLMQADLNTVQVDPVRRSEGAAAAAASPREQRVVSLRGGKSPTTNSTPQAVLSGSLTASEVYELLFLAEKRPPMPEQPVAHMPQSEPMIKWMPSSDSGAAAERLCGEATSEAPYYSAADKALLKRSFEYCWLKRHRRAVRQQLNRLVHATMAATVLKATPGTKASAAAAPAAAAKCSTKRGFVEAEVVPRSSVCLADMRYLEPMEGTWLTGAGGGTLGSGDSAHQEWHATDPRSLREEDAWFTSPANVGKVHGVATASLLAAQTADGTEEPQLNSPRSLKDAASTPVEPTPYVLQAVASSDLLFGPAEAFFEFDTEHQLRTGARSLSEQLAERRLHRQGQAATAAHARVPEAVELDPSLQFMDSDLEDVYMTQALWTRGWNIFGLTEPVAVGTGEEELSSSPPATAPTSSSARDDGPCTVDEAAAGVPSELSDARTFTQDKFWALVMAHRDAGTLLGATAARNHSSTPPESSPPLCPLRRTMKEWELFAGMQLTTLRDALRSP

SEQ ID NO: 143 - protein, 1145 aa, Artificial Sequence
  LmjF.02.0250:mRNA-p1
MPVRLLPSRRSRTARSVHRTLLCLVLSLGTLVLLSGVVMWRTMHGRGEDAQVGGKATRHPLTPGNPTVSLVPGAGADGDAPPSGSDRGADPYTGSLEELVRLLRIYAAHRGVRVNHTYDTLPAGIAAAAGLTDSGNNSQRDAGARVAGLQLPGVELLHGLYGDGGEAGGHLSANWVLDEPEMITAEQETYVERYLVPTQAEVELTPLRVISSYYSMQGSRSLHRMAADTEKAMNGDGYAKYIQRSRTFYDVSHAARRGYGQEGSIFVAVPFTLTDITAAMVDTIRRRASTVETSSQAQQPASSSPLEARDDGFHELRFTAARCAMTVESLFRQAHRGVAVTVGTLDVVTVSGVSSAAELDFSKPSNVTFPLRAEDRAGLPHTRRYSRITCEPPDFASGWDDASYGFRWKDNLRRRRVVVPLTQLDAASAAQADLPHVDGAAAALERYFAFPYVGNYATLQLYRGESYVFFLRTGSLALPNWDLKLRLLYLRTPARNRAVLSSRPTPRVAWTALAASVAKMWDTEPFLRLSLATASRQRNGEDATGDDMAVVATAPPPDKMGSRLLAALPADVSSWLIAARTEAELVLWLVTPSWLWPTMVETLAAVRQLAASPDSPPPATASSALRLLFASDAVRGVLGDGLSTLMQADLNTVQVDPVRRSEGAAAAAASPRGQRVVNLRGGKSPTTNNTSQAVLSASLTASEVYELLFLAEKRPPMQEQPVVRMPQSESTIKWVPSSDSGAAAERLCGEATSEAPYYSVADKALLKRSFEYCWLKRHRKAVRQRLNRLVHATTAATVLKATPGTKASAAGAAAAAKCSRKRGFVEAEVVPRSSVCLADMRYLEPMETTWLAGAGGGTLGDGDSADREWHAADLRSPRQENSWFTSAVNAGKVHGVATAASLVSQAADGTEEPQLNSPRSPKDAASTPVEPTPYVLQAVASSDLLFGPAEVFFEFDTEHQLRTGARSLSEQLAERRLHRQGLTATAAHARVPEAVELDPSLQFMDSDLEDVYMTQALWTRGWNIFGLTEPVAVGTGEEELSSSASATAPTSSSARDDGPCTVDEAADGVPSELSNARTFTQDKFWALVMAHRDAGTLLGATAARNHSSTPPGSSPPLYPLRRTMKEWELFADMQLTTLRDALRSP

SEQ ID NO: 144 - protein, 1101 aa, Artificial Sequence
  LmxM.02.0250.1-p1
MRDGGEGAKAGGKAMQHPSTPGTPTVSLVPGAGAEGDARSFGGGGGVAPYTESLEELVRLLRIYAEHRGVRVNHTYDALPAGIAAAAGLTDSGESFQRGAGAKVAGLQLPGAELLHGLYGDDGQAGGHLSANWVLDEPETIMAEQEAYVERYLVPTQAEVEVTPLGVISSYYDMQGSRSLHRMAAETEKAMNDDGYATYIQRSRTFYDVSHAARRGYGQEGSIFVAVPFTLTDITAEMVDTIRRRASAVPTSSQAQRSTSSSPLEERDDGFHELRLTAARCAMTVGSLFRQAHRGVAVTVGTLDVVTVSGVSSAAELDFAKASDVVFPLRPEDRAGVPYTRRYSRITCEPPDFASGWDDASYGFHWKDNLRRRRVVVPLTRLADASAAHAGLLRGDGAAATLERHFDFPYVGRYATLQLYRGESYVFFLRTGSLVLPNWDLTLRLLYLRTPARDRAVLSSRPTPRVAWTALAASIAKVCDTKPFLPLSLTLTSRQRNRENATGGDTDVVTTAPPPEKMGMRLLAALPADVSSWLTAARSEAELVLWLVTPRWLWPTMVETLADWRQLASSPDSPPPASASSALHVLFASDAVRDVLGNEPSTLMQADLNTVQVSPVRRSDGATAAAASPRGQRVVSLRGGRSPTTNSTPQAVLSASLTASEVYELLFLDEKRRPMPGQPIVHMPQSEPTIGRVPSRDSGAAAVRLCGEATSETPYYSAADKALRKRSFEYCWLRAHRGAVRQQLNRLVHSTKAVTVLKAAAGTKAPAAGAAAQCSSKRRLLEAAMVPRSSVCLADMRYLEPMEETRLTGAGGGTLGRGDSAHQEWHAADQRSLREENAWFTSAANVGKVHGVATSSLLVSQGADGTEKPQLNSPRSPKDAPPIPVEPTPYVLQAVASSDLLFGPAEAFFEFGTEHQLRTGARSLSEQLAERRLHRQGLTATAAHARVPEAVELDPSLQFMDSDLEDVYMTQALWTRGWNIFGLTEPVAVGTGEEELSSSASAAAPRSSPARDDGKCAVDGATDGVPSELRNARTFTQDKFWGLVMAHRDAGTLLGATDARNYTTTPRESSPPLYPLRRTMKEWELFAGIQLTTLRDALRSP

SEQ ID NO: 145 - protein, 1151 aa, Artificial Sequence
  LPMP_020170-t37_1-p1
MRSRLLPSRRSRPARFARCIALCLALSIGALVLFSGLFLWKMFSDEVEGAKTGSKMPQRPSMPGHPAGSSVPDAGADGVVQPLTGNREAAPYTESLEELLRLLRIYAEHRGVRVNSTYHVPLEALTAALGLRGGGDSSQRGAEARGADLQLPGAELLHSLYGNGGQAGDHLFANWVLDDPETITAEQEAYVERYLVPTQAEVDLTTLRVISSYYNTQSSRGLDRMAAETEKAMNDDGYATYVQHSPSFYDVSHASRRGYGQEGSIFVAVPFTLSDITEEMIDTIRRRASAASALSQTPATSSSAPLQGRVESVGGGDFEELRLTAARCAMTVESLFRQAHRGVAVTIGTIDVVAVSGISSATELNIEKPADVLFPLRTADRAKLTPSHKRRYSRITCEPPDFTSGWDDAEYGFRWKDNLRRRRVVVPLAGLDDAAAAHSALPRRADTAATLEQDFALRHVGRYATLQLYRGESYIFFLRAGSLALPNWDLTLRLLYLRTPARDRAVLSSRPTPGVTWRALAASVANVWSTEPLVRLSLTTAPGGRHSEDGLGGEREAAASVPPPDKVGERLLAALPADVSSWLSAARAEAELVLWLVTPSWLWPTMVETLVDWRQLAASPDLPASATASSVLGLLFTSAAVRGVLGDAILDLSDADLKAVQVDTLANCDGDAPTKASPCGQGMVYVRSGKNSSTSRTPQAVLSASLTASEVYELLFLDEKRPPMPAQPIVHMPPSASTTTPAPFRESGAAAGRLCGEEESEAPYYSAANKALRKRSFEHCWLKEHRGAVRQQVRRLVHSTNASTVLQASPGMQAPAAGAAAAAKCRAKDSFVKAEVMPRSSVCLADMRYLAPMEGTWLTNADGGTLGSGDRAPQAHHAADEHSPLQESAWLASGANVGKVKGVATSARNAQASGRVDELQFNSPQSPGDAASATVEPTPYVLQAVASADLLFGPAEVFFEFDREHQLQTRLRSLSEQLEERRLHYQGLTAAAAHARVPEAVELDPSLQFMDSDLEDMHTTLALWTRGWNVFGLTEPVAVGTGESELPTSMPATAPAASGAGHDGQCFVDEAADGVPTELSNARTFTQDKFWALVMSHRDAGTPLGSTKERNQTPTPQASSPSPYPLRRTVKEWELFAGVDLTALHDALRSP

SEQ ID NO: 146 - protein, 1160 aa, Artificial Sequence
  rna_LpyrH10_27_0550-p1
MRSKVSQLLPGRRSRTNRAARRVLTVTALLLFGLVGFFSYRMYSSSLSPSSATEQIDLLGAKRQTTPPGEGETSAAATPAAGGDGGVAVTAGAGVASLSESLDDLVGLLRLYTAAHRIRVNRSLVEGNAAHNKTAEGMSDVPKELLLEGVSEMPFIGDDTDLLDDPAVIQAEQESYVERYIAPTQSGAALTPLRVLSAYYDPQNSRGLDHLAAAVEKRMNDDGYATHNRPSPTFYDASHAARRGYGAEGSVFVAIPFALSDITPDIVDAIAARATAPLAKSANRPPTTADAGAAAAEAADALHNPLDGADDAGAALDGDGYREIIRTAARCAVTVESVFRQAHRGISVTVGTIDVVVVSGVQSAADVHLAYPADVRRPITAEERVKAGSVPSRRYDRLTCEPPNFRSGWEDASYGFSWKDNLRQRRVLVPLTTLATTPAVKGAGAKATLSSSSPLALPHVGRYAALQLYRGESYVLFLRPGSVALPNWDLKLRLLYLRTPQRERAVLSSRPTPAVVPHALAAAVMKAWTQQPYLLFSSLTDGAAKNTGRSSTVAHGAGAQKDRAGVTNAPALDWTGRRLLQAFPDGVAAWLAEARGESALALWLVTPRWLWPTLVDALRAWRELSNGTATSTTPPTTPPQTPPMRDVFRESVLREVLGDFTAAAEHLNLTSVAVTAATTAAANEEADTAQLHGTGAVTATSQPVLTTSLTEAEVYQILILTPKRGPLPKEPITDTALFMTHNGGAASTTGEATAAGGTGTGVGAGLVACGTATTPLPYYSNEHGALVKRAFEYCWIMHHRAALRALAERLTHATDAAPILISASSKAAKNPAGGLAGKPIIAAAAAAATVMCGRNPASTVPWYDTALLVHNHTSRCLADMRYLDPSETPLLDETNKIAVGEEEERATVASWFASSQNAGQLRGSSAVPAHPPTLVDGETPAGGAAAAAAGTTTPYVLQSAASADLLFGPAEAFFDIAPEGRLRTRADARTAQLDERRGGGGGGTTLRYAETPEAAPLDPSLHYLDSGALDLYLTAALWTRGWNIFGITEAVVAGDDAPTAAPAVKTGNAGSAPMCGLTKGGNDEAEKLLSAAMKTAKSIGEEKLWALMEAHRTAGTPLGPASAPATPDTLPLSAARFPLRRTLRDYEKFANLTLAELQRK

SEQ ID NO: 147 - protein, 1155 aa, Artificial Sequence
  rna_Lsey_0379_0020-1-p1
MWYRALLLQLRRSRSSRVVHRTAIAVAVSTLVLASILCALSFTSLGNGDRFFPLNSNFAGNPAHWSGDRRSTAPNGGASAGVAVTTSPDAIPYSETIDELLKLLYIYTAARGIVVNTSVLDALNLTPMDGSPAGTVPASTPALPEHLQMAGVDELRFNGADVGRYAAQLLDDPFVIQAEQEDYVERYIAPTQFGVPLTPLRVLSSYYDPQSARGVDQLAEAVEKSMNDNGYAKYIRRSPTFFDPSHAARRGYGLEGSIFVVIPFVLSDITPDIVAAITARARAPPSAANSATAAPREAAALRNPLDGADEASAAQAGDAFYEVRRTAARCAMTVESVFRQAHHAIGVTVGTIDVVVVSEVDSPSDIDLAFPADVRRPITEAERVKDAALRKRRYDRITCEPPSFRSGRDDVSYGFSWKDNLRQRRVLVPLAKLASTAHTGAAARGGPSTFELPHVGRYAALQLHRGESYIFFLRPGSAALPNWDVKLRLLYLRTPQHQRAVLSSRPTPAVVWKSLAAAVAKVWTQHPYLLFSSLAGGEAQSTGLAGTAGQSPAGMEKGSHSARNAGAGAAAAPALDWTGRRLLEAFPFEMATWLVEARTESALALWIVTPRWLWPTLVDVVQEWRALSTGTAPAAAAPSQTPSLRDLFSEATLKAILGDGAAATANWTLASVTAAASSVAGTALLHGTGAATAASRPILTASLTEAEVYAMLLLEEKRMPPPAEPISGMSQLSKRNVNAGVNDAAGATGAAAVGVGTGAGMVACGTLGTPLSYYSAKDNALVKRAFEYCWIHHHRAALSTLAERLIHTTKASAILTSPSPHSARHGAGADGAAVRCRGDGQSTFKWYDTKLLPHNRASQCLADMRYLDPSEVPLLGVAKEGTVEEQRVAAAQWFVSPSNAGQLSGDSAVPPQPANVAEREAAATATTTTTTPYVLQSVASADLLFGPAEAFVDIAPEDRLRTRAYTLAEQLSRKQRSATSGPTAAATPEASRYADTPEAVALDPTLHYLDSDALDLYLTTALWTRGWNLFGLTEAVAAGDAAPNPVTAPVTAPVNTTAAPAADAVGSVMTQACGLAEKGNDAWESLPAEVRAAQTFAEEKLQALMAAHHAAGTPLGPVGNLTAQGTPATTRFPLRRTLQAYENFASFKLADLLKK

SEQ ID NO: 148 - protein, 1137 aa, Artificial Sequence
  LMARLEM2494_020006500.1-p1
MRLRTFLGRRLRTARFARSTFLFGALSIGALVLLSGVFMWTVADNWAGGATARSNGAPPFSTPGNPAGSLVSGASADGPEGSVQPLTGYREAAPYTESLEELLRLLRIYAEHRGVRVNSTYHAQLEAIAAVAGLSNGADDSKRGAGGGVADLQLPGVNLLHHFYSGIGHVVGHLSADWALDDPKAIVTEQEAYVEQYLVPTQAEVRLTPLRVIASYYNARGSRSLDRMAAETEKAMNDDGYATYMHRSPTFYDVSHAARRGYGQEGSIFVAVPFTLADITAEMVDTIRHRATAASMPQKTTPNASSGAAPQEGDDLVGDDGFQEWRHTAARCAVTVESIFRNAHRGVSVAVGTIDVVVVSGITTAAELPFATPADVSVPLRAADRAPLSLARKRRYSRITCEPPDFASGWDDANYGFRWKDNLRRRRVVVPLTRLDSEAANDATLLQREDIAALLGQYLDIAYVGRLATLQLYRGESYILLLRTGAVTLPKWDLALRLLYLRTPVRDRAVLSGRPTPGVVWTALAASIARVWASRPYLRLSLETASSRRSAAGEPSGGRRNRTAVPPPDEFGERLLAALPVDVSAWLSAARAEAALVLWLVTPGWLWPTLVETLADWRQIAAAPELPPSTTAPSALRLLFGNATFGDATVDELLTLREVDVKTVQVDVVRRSDSANATNASPLRNRRVHVRGGENSAVSSVPQAVLSASLTESEVYKAVLLTEKRPPMPAELTTLMAQAASTKAPAQPRTPRAAMRLLCGEETSGAPYYSALDRALVKRSFEDCWLKEHRGAVQQQVRRILRSTQATTVLKAAPGTKPPPAGAVAAAKCRPKKGFSKVEVVPRSSVCLEDMRYLVPLETPTCTGAGGGLYGRENSTHQELNAANQRLPLREEAWLTSAADVGTVHGVPTSTCVSETADGADEPTPYVLQSVASAELLFGPAEVFFNFAPEHRLRTRARSLSEQLAERRRRHPGAEAATAHAQVPEAVELDPSLPFMDSDQEDVYMTQALWTRGWNIFGLTEPVAVGLGESELLSSAAAKAPVICAGEDTEQQRIEQEADDVPPELRHARTFTHDKFWALLTDHREAGTPLGVAQARNGTTPQRAASQSLHPLRRTIKEWEVFSGVPWPALREAFHGP

SEQ ID NO: 149 - protein, 1107 aa, Artificial Sequence
  LTRL590_020007600.1-p1
MWRTMRDRGEGAKVGGKATQHPSTPGNPTVSLVPGAGADGNAPPLGGDRGAAPYTERLEDLVRLLRIYAEHRGVRVNHTYDALPAGIAAAAGLTDSGENSQRGAGARVGGLQLPGAEPLHGLYGDGGQAGGHLSANWVLDEPEVITAEQETYVERYLVPTQAEVELTPLRVISSYYDMQGSRSLHRMAAETEKAMNGDGYATYIQRSRTFYDVSHAARRGYGQEGSIFVAVPFTLTDITAEMVDKIRRRASTVPTSSQARKPASNSPLEGRDDGFHELRFTAARCAMTVESLFRQAHRGVAVTVGTLDVVTVSGVSSAAELDFPKPSDVTFPLRAEDRAGLPHTRRYSRITCEPPDFASGWDDASYGFRWKDNLRRRRVVVPLTQLDAASAAQGDLLHGDGAAAALERYFAFPYVGHYATLQLYRGESYVFFLRTGSLALPNWDLTLRLLYLRTPTRDRAVLSSRPTPRVAWTALAASVAKMWDTEPFLRLSLATASRQRNGEDATGDDMDVVATAPPPDNMGRRLLAALPADVSSWLIAARTEAELVLWLVTPSWLWPTMVETLADVRQLAASPDSPPPATASSALRLLFASDAVRGVLGNGLSTLMQADLNTVQVDPVRRSEGAAAAAASPRGQRVVSLRGGKSPTTNSTSQAVLSASLTASEVYELLLLAEKRPPMQEQPIVRMPQSETTIKWVPSSDSGAEAERLCGEATSEAPYYSAADKALLKRSFEYCWLKGHRRAVRQQLNRLVHATTAATVLKATPGTKASAAGAAAAAKCSRKRGFVEAEVVPRSSVCLADMRYLEPMEATWLTGAGGGTLGDGDSASREWHATDPRSSGQENAWFTSAANVGKVHGVATASSLVSQAADGTEEPQLNSPRSPKDAASTPIEPTPYVLQAVASSDLLFGPAEVFFEFDTEHQLRTGARSLSEQLAERRLHRQGLTATAAHARVPEAVELDPSLQFMDSGLEDVYMTQALWTRGWNIFGLTEPVAVGTGEEELSSSASATAPTSSSARDDGPCTVDEAADGVPSELRNARTFTQDKFWALVMAHRDAGTLLGATAVRNHSSTPPESSPPLYPLRRTMKEWELFAGMQLTTLRDALRSP

SEQ ID NO: 150 - protein, 1108 aa, Artificial Sequence
  LTULEM423_020006700.1-p1
MWRTMHGRGEDAKVGGKAAQHPSTPGNPTVSLAPGAGADGDAPPLGGDRGADPYTGSLEELVRLLRIYAAHRGVRVNHTYDALPAGIAAAAGLSDSGKNSQRGAGARVAGLQLPGVELLRGLYGDGGQAGGHLSANWVLDEPEMITAEQEAYVERYLVPTQAEVELTPLRVISSYYSMQGSRSLHRMAADTEKAMNSDGYATYIQRSRTFYDVSHAARRGYGQEGSIFVAVPFTLTDITAEMVDTIRRRASTVRTSSQAQKPASSSPLEGRGDGFHELRFTAARCAMTVEALFRQAHRGVAVTVGTLDVVTVSGVSSAAELDFSKPSNVTFPLRAEDRAGLPHTRRYSRITCEPPDFASGWDDASYGFRWKDNLRRRRVVVPLTQLDAASTAQADLPHVDGAAAALEKYFAFPYVGHYATLQLYRGESYVFFLRTGSLALPNWDLKLRLLYLRTPARNRAVLSSRPTPRVAWTALAASVAKMWDTEPFLRLSLATASRQRNGEDATGDDMDVVTTAPPPDKMGRRLLAALPADVSSWLTAARTEAELVLWLVTPSWLWPTMVETLADVRQLAASPDSPPPATASSALRLLFASDAVRGVLGNGLSTLMRADLNTVQVDPVKRSEGAAAAAASPRGQRVVSLRGGKSPTTNSTSQAVLSASLTASEVYELLFLAGRRPPIQEQPVARTPQSEPTTKWVPPSDSGAAAERLCGEATSEAPYYSAADKALLKRSFEYCWLKGHRRAVRQQLNRLVHATTAATVLKATPGTKASAAAGAAAAAKCSRKKGFVEAEVVPRSSVCLADMRYLEPMEATWLTGAGGGAWGDGDSANREWHAADPRSPRPGSSWFTSAANVGKVRGVATASSLVSQTAGGTEEPQLNSPRSPKDAASTPAEPTPYVLQAAASSDLLFGPAEVFFEFDTEHQLRTGARSLSEQLAERRLHRQGLTATAAHARVPEAVELDPSLQFMDRDLEDVYMTQALWARGWNIFGLTEPVAVGTGEEELSSSASATAPTSSSARDDGPCTVDEAADGVPSELSNARTFTQDKFWALVMAHRDAGTLLGATAARNHSSTPPESSPPLYPLRRTMKEWELFAGMQLTTLRDALRTP

SEQ ID NO: 151 - protein, 874 aa, Artificial Sequence
  Tbg.972.2.930:mRNA-p1
MRSETRRRGRRCITVPMYMVLPALVMLTFLLWNNMSREHENRMRGGHIGEGSHAVRGGLPGVENLRASPAVFSFTTKLLSVLTAFVDQETDGMPASVAAAGGATDMFGLPPNATPAAILLEYYETQLPKFNNELEKRLDNGSIKNVTHSDTYWSPTHVARRGYGLEGSIFVGLLHHETPLVRMRRSVSLESVCAMTVHNLYESALWSVAIFTGIVEFLPDVMTAEESGGRGGHNSSRWPFPPSSPCIPAAYQSHTCAERYGFCPRDNIRLRQLRVSAKSRRHGKGSNMGGGEGNVKVSEKKENPRSRRAEDDYEHAGYRDGDASSGSDASGGPSDFTSIASQRYATLALYRGETYVMFLNAGVLLVPSWDVTARLMLLRLPSRRPILSQMANIIQRDVVHRAWEEVVVRHVSNEGHRHEGVKDHGDQQFRDDQRGKERGGTEDYFNVAHERNPSKKRSGSTLYDLEGLRLHSSDGMEDKEKGDGNGESAAEGARGFGSEDVVEFLFRLPTEEDGGEATSGAEPLNYPRNGASIPNVRTRMPNSAQLYWMKKLREPLRKKLLTSMSEQNTTSYVCGVAVKMQHSEEGCRKVCDAKSDGGSSGCGNVENGEDVSAAVSGGEGAKFKLRYESRRRLTYVLRDRRYMEPLPIHWCNEKNDAVCLGSRRQESFPSSLSQPWLSTDFLFTRAGAFFDFSHDAADHQNSHNNSSSGNAGNHVPLDPYMGFLTPDEEAVLLAGRLWTHGWDFYAPTEPIAFAAAVHAEGAGNGTSGNNKVANMSSKVRDARLRGLVRLNFVLFGQSNAARGLRSDGEAALKHVEKYGLGSRRSRESFLQHVGLRSSRSGRMICTQEDDFDCVQKNAKNPWKWYHCGEVCSGL

SEQ ID NO: 152 - protein, 640 aa, Artificial Sequence
  TcIL3000_2_200.1-p1
MHSRATRQGQLRRVLRFLVLLAVFVALNVAYILVMFASRYATVEGKSDFGNGGNLTAGFEGVEMPHRPGAAVSYAAHLLLLLETYLGKGSGGLLRGSDTWTPAFPSNATPHSVLSGYYSEGLPKLNSRLERRLDGGSMMDGVHSDSFWSTPHIVRRGYGLEGSIFVALMHREVPSSRERRPVQFESRCAMTIYDMYETAQWPVAIFTGIVEVVHDAVSGKEPKGRDGEGSPRWRALPPSRCLPAAYQSHSCAQRRGFCPRDNIRLRQIRGPTKSESEKRARGMKEKGGRSQRVDGNGYNGGSKGQTSDSDGEDNYRRDFTSSAAHRYATLSLYRGETYVLFLNDGLLLVPSWDVKTRLMLLQLPSRYPVLTQKANIIARGIVRQAWKGSVLCNATITSSNNGKAAEDMDTYNCDPNQKRKRDKSTDTSKRAPLRSRLDHGCAAGTLDLNSGSDNGQCSRGLWEEDVVEFLFRLPSDDVETSGSYGVDDHMDEAEPVSPKTVGDHPSFRQSRQPNRIQLYWMRKLRETLRTELKKRMSEWDTTTFICGVMVKVLDELRVKNVCTEGNRHCGAGMGNTSSSEEGGGILRLRTNSVRRLSDTLHDPQYMHPSPLHRCVTNGLTPRASTPVSKIVPASFLHNRG

SEQ ID NO: 153 - protein, 874 aa, Artificial Sequence
  TevSTIB805.2.1310-t26_1-p1
MRSETRRRGRRCITVPMYMVLPALVMLTFLLWNNMSREHENRMRGGHIGEGSHAVRGGLPGVENLRASPAVFSFTTKLLSVLTAFVDQETDGMPASVAAAGGATDMFGLPPNATPAAILLEYYETQLPKFNNELEKRLDNGSIKNVTHSDTYWSPTHVARRGYGLEGSIFVGLLHHETPLVRMRRSVSLESVCAMTVHNLYESALWSVAIFTGIVEFLPDVMTAEESGGRGGHNSSRWPFPPSSPCIPAAYQSHTCAERYGFCPRDNIRLRQLRVSAKSRRHGKGSNMGGGEGNVKVSEKKENPRSRRAEDDYEHAGYRDGDASSGSDASGGPSDFTSIASQRYATLALYRGETYVMFLNAGVLLVPSWDVTARLMLLRLPSRRPILSQRANIIQRDVVHRAWEEVVVRHVSNEGHRHEGVKDHGDQQFRDDQRGKERGWTEDYFNVAHERNPSKKRSGSTLYDLEGLRLHSSDGMEDKEKGDGNGESAAEGARGFGSEDVVEFLFRLPTEEDGGEATSGAEPLNYPRNGASIPNVRTRMPNSAQLYWMKKLREPLRKKLLTSMSEQNTTSYVCGVAVKMQHSEEGCRKVCDAKSDGGSSGCGNVENGEDVSAAVSGGEGAKFKLRYESRRRLTYVLRDRRYMKPLPIHWCNEKNDAVCLGSRRQESFPSSLSQPWLSTDFLFTRAGAFFDFSHDAADHQNSHNNSSSGNAGNHVPLDPYMGFLTPDEEAVLLAGRLWTHGWDFYAPTEPIAFAAAVHAEGAGNGTSGNNKVANMSSKVRDARLRGLVRLNFVLFGQSNAARGLRSDGEAALKHVEKYGLGSRRSRESFLQHVGLRSSRSGRMICTQEDDFDCVQKNAKNPWKWYHCGEVCSGL

SEQ ID NO: 154 - protein, 789 aa, Artificial Sequence
  DQ04_04291000-t26_1-p1
MVAVRRGAGVLGRLRLRRGAAWSALTLVVLAVVCYMVMLPVLLNNMSIPATTTAEIRLNNERQQQPQREALSYVTQLLTLLKRFELMHNESTKAIAEAGAAAKSTIETPESMLSAYYEEDLVRLNNALEKSLDSGYAEHVVHSDAYWSPYHAVRRGYGLEGSIFVGLLHHEASYTTRRTTPPREGKCAMTLKNIYDNARWPIGVFTGVVEVVLDSAARAKTTATGGDQSGNSTWSPLPPSVCVPESYLSMDCEERYVFCPADNIRVRQLRFPLPSEGVDSTAAATPRRRTTRTPFSSVAAQRYATLTLYRGETYVLFLRDGLLLVPQWDAVTRLLLLQLPSRHSVLSQAPNTVSDEAVRAAWTGAVISSVNGLVLASTQLYRNISGAAQPPTLRPMDKIEKWMMTFDWALDTNAVRLHTSGGAERTGSVSGTRGGDLGITEAEVVDHVFGSSSLTEAPYTSRSRLDGSHASSGGIDIRSNANKDRTPNTRRRRDIQLYWLYRFREALQRLLILEAAKQNTTSYIAGFRPEKLDESLPSQQQQQQQKQQAMPLFFHITNVNRLSHVIQDKRYMQPSPTHWCTEYGEQGCPDVMSKDRKSNTKLPFQLLSWITTDFLFARAEAFFDYTRGDESHTSIHSEGSTAKRGSDHVPLDPFIQFVTPDEEAVLLSARLWTHGWDLFSPTEPIVFFSASNTEATSRATEKTHSPTTTRLRWRSVARLCHILFGARRDGNGEDAFAETEYAEALREVGRYGLGERRSREQMLRFLDLDGGATQPQQRFAAWCKDHGMR

SEQ ID NO: 155 - protein, 789 aa, Artificial Sequence
  TRSC58_03864-t26_1-p1
MKRSVRLFVLLTIVVLLVLLSIVMSGPAVDEMGADYMDVEDDAHELEHQTRLTHHDMVGMQRQIERSKQSVLLHAKGLLSLLQRFSDEITIDATNARPGEVARSVTNSLKTPEAILSQYYGTELLRLNNLHEKDLDAGYAENVVHSDTYWSPSHVTRRGYGLEGSIFVGVTHSQEAASSSEVETACAATVRSLYEAARWPAAVFTGVVDVTLLTTPTPRGTTASTASSKKTETQSPEETPAWTPTPPPTSVCVPRAYLLPSCAERASFCPADNIGVRQVQVGPTSAGTVGAAGNARRRRMHPLFSSVAAQRYATLALYRGETYVMFIAAGLQLVFKWDVLTRILWLQLPSRHAVLSQTPVPISRQAVRAAWDAVVVKHVEGIIAATKQFPNVTAEGAPRSNLSEEKLGNGVDRWLESIRWTLNLKAVQLQLAKDAAAGSGEKEPTGNEKDTGMREEDVVSYIFHHDAAVFRHTKEQAPTTGGATPMKEGLTPGAASRRDIQLYWLRQFYETLRGALMNEVVEQNTTSCLSGLQMKEPKSRQYGESVFRLHATRVKRLSHAMEDPRYMRPSPFHACGRKGASACPDLSEAKDVCHTDAMLPYLRQSWVTTDFLFTRAEAFVDLPREGGDDYGGPTNADTVRLDPYLSFVGADEEAVLLSARLWTHGWDLFSATEPVAFVVAQPRTEAASDVNAYTLSPTQQRLREQSVARLRHILFGKTGTAGAAPNVEAAALRDVEHYGLGERRSKEKLFYFSGLQEATQREGLVEPDTAAQHAEESICPAFFCRGSQS

SEQ ID NO: 156 - protein, 928 aa, Artificial Sequence
  TM35_000391740-t36_1-p1
MTHSSRRCCLYTSLFLRKRAVVSLLFLLILFAVVCTTLLWTQLMEDIIITTTSSSPALQKNSNDNSQQQEGKLKEQLLQLEKIQNLDLVSYVSRMLSVLSSFLNEQESHHVDHKILNISYTPRKENTPESILSDYYEKELAQRNNFFERTIDSDYSENILHSDSYWDPIHTVRRGYGMEGSIFVALLHQEMSIFTRKEEEEKEEERKESESACAMTVQNMYETARWPIAIYTGIVEVILDTTTTTTTTTIPTTNENTGKEAEEEQKKKQQQQQQSKWPKQPISACIPRLYRQPTCAEGFVFCPLDNIRLRQVRVNGESNQTTTTLSSSKQRNRKHLFSSIAAQRYATLTLYRGETYVMFLRAGLLLRPHWDILTRLLWLQLPSNYAVLSQSPLHVNKAILRSAWNETIVKSVKSIILATQRMQMDRNKNNNNTNNTNTTNSDNNNNNNNNNNNNERKSGVYKWLENARWALHEDLVRLDDHPTTPRGLTEEDILRYLFTTTSSSNSNSNSDKNKKKEKEGNTSNVNGEEIREEVQLYWLNHFRNVLYPIVLSALSNHSVTPYLCGLEMRKGMESQQQEKEEEEKEKEKEEVKENENTLLLKLHSVNVKRLSHALQDLKYMQPSSTHYCEGESHPACTDVKMMTMMEDEKEKKLREKPPFSSSFQRNNNNNNNNNNNNNKSLPYLLQPWITTDFLFTRAEAFFDFSQTPMDNSPPPPNNNNNNNNNNNNKENKNNKNIDEKSNEKKTKGRSVPLDPYLHSLMRDEESVLLSARLWTHGWDLFSPNEPIVFLGPHQQQQQQEEEEEKEKREKESLSLGEKKNKIKVSEKLKRMRELSLIRLRFILFGIRESTGETEKEKKKKISLLELETEALQDVGRYGLGIHQSREDLFRFAGIEKENERKEEKEEREEGNESRKSMKDYLSWCSDYE

SEQ ID NO: 157 - protein, 1046 aa, Artificial Sequence
  human O-GlcNAc enzyme OGT (Uniprot: O15294)
MASSVGNVADSTEPTKRMLSFQGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 158 - protein, 527 aa, Artificial Sequence
  human EOGT (Uniprot: Q5NDL2)
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMHVLCQPKETSDSSLVCSRYLQYCRATNLYLDLRNIKRNHDRFKEDFFQSGEIGGHCKLDIRTLTSEGQRKSPLQSWFAELQSYTQLNFRPIEDAKCDIVIEKPTYFMKLDAGVNMYHHFCDFINLYITQHVNNSFSTDVYIVMWDTSSYGYGDLFSDTWNAFTDYDVIHLKTYDSKRVCFKEAVFSLLPRMRYGLFYNTPLISGCQNTGLFRAFAQHVLHRLNITQEGPKDGKIRVTILARSTEYRKILNQNELVNALKTVSTFEVQIVDYKYRELGFLDQLRITHNTDIFIGMHGAGLTHLLFLPDWAAVFELYNCEDERCYLDLARLRGVHYITWRRQNKVFPQDKGHHPTLGEHPKFTNYSFDVEEFMYLVLQAADHVLQHPKWPFKKKHDEL

SEQ ID NO: 159 - DNA, 4005 bp, Artificial Sequence
  pLMTB6681
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtaccggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccatgaagatttcggtgatccctgagcaggtggcggaaacattggatgctgagaaccatttcattgttcgtgaagtgttcgatgtgcacctatccgaccaaggctttgaactatctaccagaagtgtgagcccctaccggaaggattacatctcggatgatgactctgatgaagactctgcttgctatggcgcattcatcgaccaagagcttgtcgggaagattgaactcaactcaacatggaacgatctagcctctatcgaacacattgttgtgtcgcacacgcaccgaggcaggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 160 - DNA, 4796 bp, Artificial Sequence
  pLMTB6683
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtaccccgaccaaggctttgaactatctaccagaagtgtgagcccctaccggaaggattacatctcggatgatgactctgatgaagactctgcttgctatggcgcattcatcgaccaagagcttgtcgggaagattgaactcaactcaacatggaacgatctagcctctatcgaacacattgttgtgtcgcacacgcaccgaggcaaaggagtcgcgcacagtctcatcgaatttgcgaaaaagtgggcactaagcagacagctccttggcatacgattagagacacaaacgaacaatgtacctgcctgcaatttgtacgcaaaatgtggctttactctcggcggcattgacctgttcacgtataaaactagacctcaagtctcgaacgaaacagcgatgtactggtactggttctcgggagcacaggatgacgcctaactagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggccagcggcagggtttaccctgtgtcagcaccgcgcccgcttttaccaacttacgtatcttttctatttggcctttaccggctacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggctgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 161 - DNA, 4429 bp, Artificial Sequence
  pLMTB6948
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtaccaacacttgatcatcaatgcgcaatgtgcgcgtgttgtgtgtgtgtgtgcgagcgcacacacacatgcacacgactcacgttgtcacacaattgagagctctctcttctccttcccctctctctcctctctcctctctccagagctctctcttctccttcccctctctctcctctctcctctctccagagctcgagccaccatggtccggaagaagggctccctgatcctgtgcggcgccttcctgttcgtcgcctggaacgccctgctgctgctgttcctgtggggccggccccccatcggccggctgggcgagggcggcggcgccgagcccggcgccggcgaggagtggggcgccggcaagtccaaggtcggcggcgccaacggcctggccggcgaggtcatccggctggccgaggaggtcgagtccgagctggagacccagaagaagctgctgaagcagatccagtcccaccgggagctgtgggagcagcggaaggagctggagaagcgggagtccgaggacaccaaggacgagaagatcgacgtcgagcccaagaagccccggcagatccccgccgtccacctgtcccacaaggtcgtcgaggacgcccagaccgtcaccaagaagatgcagaccctgatggtcacccccccccagctggtcatgaaggagcaggagaccgaccagaagaacaagcagatgatggaggaccagctgggcctgaccaccccctccccccagatcatcatccccatcctggtcatcgcctgcgaccgggtcaccgtcaagcggtccctggaccggctgatccagtatcggccctccgccgagctgtatcccatcatcgtctcccaggactgcggccacgccgacaccgcccgggtcatcggctcctatggctcccagatcacccacatctcccagcccgacctggccgacatccccgtccggcccgaccaccggaagttccagggctattataagatcgcccggcactatcggtgggccctgaaccaggtcttcaacgtcttcgcctattccaccgtcgtcatcgtcgaggacgacctggaggtcgcccccgacttcttcgagtatttccgggccctgtatcccatcctgcggtccgaccccaccctgtggtgcatctccgcctggaacgacaacggccgggacggcctggtcgaccccggcaaggccgagctgctgtatcggaccgacttcttccccggcctgggctggatgctgctgaaggaggtctgggccgagctggagcccaagtggcccaaggccttctgggacgactggatgcggcaccccgagcagcggaagaaccggtcctgcatccggcccgaaatttctcggaccatcaccttcggccggaagggcgtctccctgggccagttcttcgaccagtatctgcggtatatcaagctgaacaccgagttcgtccccttcaccaagcacgacctgtcctatctggtccgggagaagtatgacgtctccttcgagaaggacgtctattccgcccccctggtcaaggtcgaggagctgcagcacggcggctccctgaagggctccggccccttccgggtccagtattcctcccgggactccttcaaggtcctggcccggaacctgggcgtcatggacgacctgaagtccggcgtcccccgggccggctatcggggcgtcgtctccttcatctcccggggccggcggatctatctggccccccccgagggctggaccaagtatgacgtctcctggtcctaaggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 162 - DNA, 4008 bp, Artificial Sequence
  pLMTB7084
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtacctggaacagcggcgcgctgacgagcggcgtgcacacgttcccggcggtgctgcagagcagcggcctgtacagcctgagcagcgtggtgacggtgccgagcagcagcctgggcacgcagacgtacatctgcaacgtgaaccacaagccgagcaacacgaaggtggacaagaaggtggagccgaagagctgcgacaagacgcacacgtgcccgccgtgcccggcgccggagctgctgggcggcccgagcgtgttcctgttcccgccgaagccgaaggacacgctgatgatcagccgcacgccggaggtgacgtgcgtggtggtggacgtgagccacgaggacccggaggtgaagttcaactggtacgtggacggcgtggaggtgcacaacgcgaagacgaagccgcgcgaggagcagtacaacagcacgtaccgcgtggtgagcgtgctgacggtgctgcaccaggactggctgaacggcaaggagtacaagtgcaaggtgagcaacaaggcgctgccggcgccgatcgagaagacgatcagcaaggcgaagggccagccgcgcgagccgcaggtgtacacgctgccgccgagccgcgacgagctgacgaagaaccaggtgagcctgacgtgcctggtgaagggcttctacccgagcgacatcgcggtggagtgggagagcaacggccagccggagaacaactacaagacgacgccgccggtgctggacagcgacggcagcttcttcctgtacagcaagctgacggtggacaagagccgctggcagcagggcaacgtgttcagctgcagcgtgatgcacgaggcgctgcacaaccactacacgcagaagagcctgagcctgagcccgggcaagtaacctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 163 - DNA, 3674 bp, Artificial Sequence; identical to SEQ ID NO: 36
  pLMTB7805

SEQ ID NO: 164 - DNA, 3794 bp, Artificial Sequence; identical to SEQ ID NO: 37
  pLMTB7807

SEQ ID NO: 165 - DNA, 3896 bp, Artificial Sequence
  pLMTB7810
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatttaattaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagcctcggagatccatggagggagaatgatgatgtgaccgaggtggcgcgctcgcacgtgtcctcctcctccccctcctcctcctcttcttcttcctcctcatggccgccctctgcggtggtcctctctcaccttttcatgtgttcctgtgtggcgtgcgtgtcgctcaggggattcccgtgtgtgtgtgggggggggggatgccggccactggggcgtggggcgtgcgggcgcggcagcaggctctcgaggtgatggctggttggactcttggcgtggggggcggtgcgggtgtccgttggttgaccggcccgtagtggagcacgggcacaagtggacaccggcaggaacgttcctgctggtcactgtttcgatactgctttcctcgtcaccctgtgcgtcgctctctgtgcccctctcctcccctctctgtctctgtctctctctctgtgtgagtatgtgtgtataggtgggggggggagagagaagctgtgcgtgtgcacggtggtattgtgtggcctgcaggatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 166 - DNA, 3794 bp, Artificial Sequence; identical to SEQ ID NO: 38
  pLMTB7811

SEQ ID NO: 167 - DNA, 3661 bp, Artificial Sequence; identical to SEQ ID NO: 39
  pLMTB7812

SEQ ID NO: 168 - DNA, 3761 bp, Artificial Sequence
  pLMTB7813
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatcctgcaggctctctcgtgctggacgcctctgcaccactgcgtcgcacacgaatcgccggtagtgatggtgctttttcgtacaccgatgcgcgcgagcacctccgctcttgccgcgtccttctgagctttgctgctacgcgtcgccgtggcgtccttccatcgtgttgcttttctttcaacgttccttctgcagcgatgcgactggcatccccttcgtattagcaccagcaccaacaacacggcagctgcgcgcacttttgtcgcacgtgactgcgcgaccgcgatatctgctttccattctgcagttctctacacacttctttgtgtctttccttcccccctttcgagcgcacacacgcgggcgcgctcagaatccgcctcgcctgctgtcctcctgtgggcgcgcgcgtaatcgggcacgcgtcaggcagcgccacagaggcctgcccagacagcgaacgggtccatcggacaccctcggtccccggcattcgcaggactgtgggtcctcgagagtatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgttcgaaatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 169 - DNA, 4439 bp, Artificial Sequence; identical to SEQ ID NO: 40
  pLMTB8223

SEQ ID NO: 170 - DNA, 3995 bp, Artificial Sequence
  pLMTB8234
atgcggttccggatttacaagcgcaaagtggtcatcttgaccctcgtcgtgattatatgcggttttgcagtgtggaacagtggcaaaccgaagaaggccagcacggtgtttccgaaagaggtggagacagtgaagcgcagtagtgtgggcagccaaatccaggcgaccattcctgtcacgcggaagccgatcaacgagtcgatcccagagaagcagcagcagcaacagcctgtggcaaagtctgaagcagacaacacgacacttgtctaccggggcatcgtgttccagttgaactttgaccagaacctcaaaaacgaggagaagtttcgagcggttcgccagaaggacgacctggttatcgtcgtccaggtgcacaaccgcccggagtatctgcgtcttctggtggatagcttgcgaaagagcaagggtattgagaacatactccttattttcagccacgacttctggtcgcctgagatcaatcaaatcgtagcttcggtagatttctgcctcgtgctgcaaatcttctttccattctccatccagttgtatccccaagagtttcccggcaacgacccccgagactgcccccgcgacatccctaaaaaggaggcactgacacttggctgcatcaacgcagaatacccggattcatttggccactaccgcgaggccaaatttagtcagacgaagcaccattggtggtggaagctgcattttgtgtgggaccgggtgcgggtgctgaaggaccataaggggctggtgctgctgatcgaggaggaccactacctcgctcccgatttctaccaccttctgaagctgatggcaagtctcaagaaggagcagtgccctgactgtgatatactctctctggggtcgtatggccacatcggctactcatcaaaggcaaataaggttgaggtcaaggcctggaagtccacggagcacaacatgggcatggccctcaaccgcgatgcctaccagaaactcctccgctgcacggacgcgttttgcacctatgatgactataactgggactggagcctgcagcatctgacagtcacgtgtctgcccgcgtttctcaaggtgatggtttcggaggcaccacggatatttcacgctggcgactgcgggatgcaccacaagaagtctgcctgcatgccgagcggccagaagacaaagattgagaacgtgctccagaatagcggtaatcagctcttccctaagcagctcttgatcacgaagcgactgcccgcgtcgggggcgaagggcgtagccccccatgtgaagaacggcggttggggcgacatccgggaccacgaactgtgcaagtcttacctgcgccttcagtagatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 171 - DNA, 3986 bp, Artificial Sequence
  pLMTB8235
atgctgaagaagcagtccgccgggttggtgctgtggggcgcaataatctttgttggctggaacgcgctccttctgctttttttctggacccgccctgcccccggacgcctcccttcggacagcgctctcggggacgaccccgcaagccttacgcgtgaagtcattcacctggcagaggatgctgaggcggagcttgagcgccaacgtggcttgcttcaacagattaaggaacactacagcctgtggcgccagcgctggcgggtgccaacagtcgctccaccggcctggccacgcgtaccaggaacaccgagccccgctgtaattcctatattggtgattgcgtgcgatcgatctacagtccgccgctgccttgataagttgctccactatcgtccatccgccgagcacttccccatcatcgtctcgcaagactgcggtcatgaggagacggcccaggtcattgcaagctacggcactgcggttacgcatatccgtcaacccgacctctccaatatcgctgtccaacccgaccaccgaaagtttcagggatactacaagattgcacgacattaccggtgggcccttggacaaatttttaacaaattcaagttcccggccgctgttgtggtagaagatgacctcgaggtggcacctgacttctttgagtacttccaggcgacgtacccactgctgaaggcagaccctagtctgtggtgtgtgtccgcgtggaacgacaatggtaaggaacagatggtggatagctcgaagccagagctcctctaccgtactgatttctttccaggccttggatggctcctcttggcagatctgtgggcggagctcgaaccgaagtggccgaaggcattttgggacgattggatgcggcgtcccgagcagcgcaaggggcgtgcgtgcatccgaccggagatcagccggacgatgacttttggtcgcaagggtgtatcccacggccagttttttgatcagcacctcaagttcatcaagctcaatcagcagtttgtgcccttcacgcagctggacctgagctacttgcagcgcgaagcatatgaccgcgactttttggctcaggtgtacggtgcgccgcagcttcaggtggagaaggtccggaccaatgatcgtaaggagcttggcgaggtgcgtgtccagtatacgtcccgcgacagctttaaggcatttgctaaagccttgggtgtcatggatgatctgaagtctggcgtgccccgtgcaggctaccgtggaatcgtgaccttccagttccggggtcgccgggtccacctcgccccgccggagacctggaacggctacgacccgtcctggaattgaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 172 - DNA, 3980 bp, Artificial Sequence
  pLMTB8236
atgttgaagaagcagtcagcggggcttgtgctctggggagcgatcctcttcgtggcctggaacgctcttctgctcctgtttttctggacccgtccggccccgggccgcccgccgtcggtctccgcactggacggcgatcctgcttctctcacccgggaggtaattcgcttggctcaggatgcggaggtggaattggagcgtcagcggggcctcctccagcagattggcgacgcacttagctcgcagcgggggcgtgtgccaacggcggcccctccagcgcagccccgcgtgcccgtgaccccggcaccggcagtcatcccgatcctcgtgattgcgtgcgaccgtagcacggtccgccgctgtttggataagcttttgcactatcggccgtcagcggagcttttcccaatcatcgtgtcccaggattgcggacatgaggaaacagcgcaagctatcgcgtcttacggcagcgcagtgacgcatattcgacagccggatctgagttctatcgccgtccctcctgatcatcgaaagttccagggatactataagattgcccgtcattatcgatgggcccttggccaggtattccgccagttccgtttccctgccgccgtcgtagttgaagacgacctcgaggtggcgccggatttcttcgagtactttcgtgccacgtatcctctgcttaaggcagacccgtcgctgtggtgcgtgtctgcgtggaatgacaatgggaaggagcagatggtggatgcctcacgtccggagttgctttatcgaaccgactttttccccggcctcggttggttgcttctcgccgaactgtgggcggagcttgaacctaaatggccgaaggcgttctgggacgactggatgcgccgtccggagcagcgtcagggtcgcgcctgcatccggcccgagatctcgcgtacaatgaccttcgggcgaaaaggggtatcccatggccagttttttgatcagcatctcaagttcattaagctgaaccaacaatttgtgcattttacgcaactcgacctgagctatctgcagcgcgaggcctacgatcgcgactttctggcacgggtgtacggtgcccctcagctgcaggtggagaaggtccgcacgaatgaccgcaaggagctcggtgaggtgcgggttcagtacaccggtcgcgacagttttaaggcattcgcgaaggcactgggggtgatggacgacctgaagtccggcgtgccccgcgcgggttaccgcggaatcgtgacgttccagttccgcggccgccgagtgcacctggcgccgccacttacgtgggaaggctacgacccttcatggaactagatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 173 - DNA, 3861 bp, Artificial Sequence
  pLMTB8281
ggtagactcgtgccgcgcgctgatgatgtaggtgcacgcgtgcgtgtgctgcagcggagccgccgccaccgcgactgtgtgtgtgtgcgcgcgtgacgaccggctcgaggaaggaggagcgcgcgtgtgcgtgcgatgcgcctcctctttttttttcgccctcgtcggtttttttttttctgagaggacggcggcggcggatggcggggcggcggcgctgacggagcggccacgctctgcacctccccgccctccgccgtctctccgttcgccgtcctctccttcctcgtgcgtgcgtctgccgcgcatgcacacgcgcgcgcgttgccgtagcgctgtgtatctgtggaggagggccttgtctctccctccccgtcgctgagagatgaaggggcaaaaagagagagcagtgcgcatgtgtgcctccgctccctggagctccccacgagccccctgcgccacgcacctgcgaacctgcacagcggcccacctgcccgcacacgtgagcagaaatgggtgtgtggagcgggtgatgtcggcgcgcacacgcgcgcgcgctgaccactccgacgtgaaaacacggaagagcgaggctggcaaggcagggcaggaacctgatcacgtgcgcgcgcacaaacggaatgagcagctcctgaagaggagatggggctcatgcacgcagacacgcacgtgcacactcctccgtcttcacggagcgcggccctgctgctgctgccatgtgccggacgtctgccacgcgtctcttccccacaccttgctcttcccccccccccttccctcccggcgaacacaaaacacgcgcacgcccaccgaaacaacaacgcgcagctcttcgctctcgttcttcgaacaaacacctttaaaccgccttccaacccctctttcttctttttcagccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 174 - DNA, 3848 bp, Artificial Sequence
  pLMTB8297
tcagcgttccgtagcgcgctgcacatccggtactgcgttccagcgcatcacgcgacgcacagcaacacaaattttcgttttgtttctcttccattcgaaaaaaaaaagataacacccaccccacttaacctccataacaagagagcgtgagaggagagtctgctcttggccttcacaccgcaaatgcagcaaaacgcggcttgtacgcaacgcatctcttagcacgtcaagctaagcagaatctttgcgtacggcaaccaggctctcatcgacccgtcgttcgctcctcgctcctccggcattcttgagccacgacgcgtatgcttggctccgtgcgtctgcgagcgtttgtgcgtttctcaaatacaagccgaggggccaccacgtttatctttgccgctcgacgcacctccttcaactacatgtacttacgacccctcgatctaaaaacctctgcccatcgcatcacttctcattctgtcgttgtgcctctttctaccttcatctttcgcttgtgctttctttcctaatacccttctcgtgtaatccctcatcacttttcctctacagctcgtttcgttcccttgccgaaaatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 175 - DNA, 3544 bp, Artificial Sequence
  pLMTB8310
gcagcggccccttccgagtacagtactcgagccgagacagtttcaaggtccttgcccgcaacctcggggtgatggatgacctgaagtcaggcgtgccacgcgccggttaccgcggcgtggtctcgttcatatctcgcggccggcgcatctacctcgcgccccctgagggttggacgaaatacgacgtgagctggagctaaattgcacggctcttatttgtcctttgaagtatatatatatatatatatattctgttttcgacttcactgagaagcggagaaatatcattaaaaaatttcagtgggcttgaatgtcgctgactaaatgtgatgcacatctcgaaagagatgcgtaggagatcgagtggctgacagtttttgtgttcaaccacttcccctccgttacaaatgtgcggataactccgtattttccggatgtggcacaatgaaaacgatatgtggatatagagctgttttccttgcctgtgctcgttatgtttgttttcttgtctctcttctgtcttcctctcgagattactgtgaggaggaaagctatcatctgtgatcttacatacctagcctcttttcgcgattacaaaggtactgcaggctcagcgcacatagatttactctctgaagggactgtgctcagtccatttttagactaactgaggagcactgacgacaacaaggatacataaacatgcggttccggatttacaagcgcaaagtggtcatcttgaccctcgtcgtgattatatgcggttttgcagtgtggaacagtggcaaaccgaagaaggccagcacggtgtttccgaaagaggtggagacagtgaagcgcagtagtgtgggcagccaaatccaggcgaccattcctgtcacgcggaagccgatcaacgagtcatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 176 - DNA, 3670 bp, Artificial Sequence
  pLMTB8311
ctgcatgccgagcggccagaagacaaagattgagaacgtgctccagaatagcggtaatcagctcttccctaagcagctcttgatcacgaagcgactgcccgcgtcgggggcgaagggcgtagccccccatgtgaagaacggcggttggggcgacatccgggaccacgaactgtgcaagtcttacctgcgccttcagtaggtcctccggcctgacagcgcgcgcgccgctgtatgtgcgcgtgtgcgcggcttcccactggggccagcgatgaggcgcatcatacctccatagagaccctatcttttgttttctgggcttcccagatgaccacttgattccttccttcctttgatttgtttctctcctcccctccgcagagggtacgagtcagggtaggctcggagaaagcttgccgcatccacgatgagccacggctgtctctctctctctcttgaccgggacaggctgttgcccagtcacgcgtatcggcgtgcacacccgctcttgcgccctgccccactattcgtcgaatgatgcgctacgcgcatgacaggcgctgctgcagcgctgctccctgcggttgctgagtgcgtacatgccgttgctactgatgtgtttgcactgcatctcacctcgctctctttgcgcatgcgcttgcccttcctccctcctcgcgaccgtgtcggtcctctcgcgccgctgtggcgcagctcgccgccttccactcccccaaacacacacgctcatacgctcatatagcactcgtgcgcaccgacacacccacaccccctcctctctctcttctccccaacctacccatcgcagccatgctgaagaagcagtccgccgggttggtgctgtggggcgcaataatctttgttggctggaacgcgctccttctgctttttttctggacccgccctgcccccggacgcctcccttcggacagcgctctcggggacgaccccgcaagccttacgcgtgaagtcattcacctggcagaggatgctgaggcggagcttgagcgatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 177 - DNA, 3849 bp, Artificial Sequence
  pLMTB8313
acaagaagacgtgccgcccttccactcagtcagcccagatcgaaagcctgctcaataacaacaaacagtacctcttcccagaaaccctcgtgatcggcgagaagttccctatggcggcgatctccccgccccgtaagaacggggggtggggcgacatacgtgatcatgagctctgtaagtcgtatcgccgcctccaatagagtcgtaggccgatgctcatatcttccccttttttcacggtgccgttccttttcttctttcatttcttcccttccgagacaacaaataaacgcaacacatagaagtatagacaggaactgcgccaagctgtgtattgcccttctcccccctcccacaacgacacagtgtgtgcgctgttcatggacgcttcatgtgaggaggaacgcgacgagagacggacagggatggagagccgcgctgaacacgcaaagcgcccgcccacagggacacaaacagaggcacagatggcccgctactggcttccttttcgccgccaagagggcgctgtgcatgcgcacgtgtggggtggcggtggcccaatagcacaagcgtgccgctgtgtatctgtgcatgacacagacatgcaagcatcttgctgctccggctccttttctcgtctgagtgtcggtcgttttttctgtctctcgtacgccaccttgatctttctccatccttccccctctttatctctcgccatctctgtgcccccgcttgtgcgaactgccggtgtgcgaaacccccctcccccaagaaggaggtatttgcgttctttctcgtcgtgtcttcccggcctgacgtttctctctagtcttctcggttttgcattctgagtgctttcatccctgctttccgtgagtccagcgtgcgctgcgcttagctacccgtgtgtgtctcacacacctacaccccgcctatactaaccctccgccctggcaccccctctctccatctcttctcttcgtcgcacgcgtgcacgccatccaatcatgttgaagaagcagtcagcggggcttgtgctctggggagcgatcctcttcgtggcctggaacgctcttctgctcctgtttttctggacccgtccggccccgggccgcccgccgtcggtctccgcactggacggcgatcctgcttctctcacccgggaggtaattcgcttggctcaggatgcggaggtggaattggagcgatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 178 - DNA, 3912 bp, Artificial Sequence
  pLMTB8314
agctcggtgaggtgcgggttcagtacaccggtcgcgacagttttaaggcattcgcgaaggcactgggggtgatggacgacctgaagtccggcgtgccccgcgcgggttaccgcggaatcgtgacgttccagttccgcggccgccgagtgcacctggcgccgccacttacgtgggaaggctacgacccttcatggaactagggtccttgtgaccgcgcgtttggcggactgctcaacagagcgggctaacgctgacgaagatatgctggtttccctgtgtttgtgatttgccatcctttcgtgtcaaaaagaaacaacaacaacagcaacccgtttaggccaagaagcgggcgctcggactctttccctgcctgccccatccccatgaagcacgccggctgtcgcactgggcacctcatgaccctgttgatagcgctggaggccttcattgcgtgctggttgtgggggggggtggaagggggagaggcgtgttgtattcatgtgaggtggtggtggcattgcgcagcggtgggaaaagcagggtcttttccgtactccgtgacagagctgccgtgctcatcttttcccggttcactgcttgcactgttggctgcctcgccttctcccctccccctgcccccacgaaacgcggttaccgcgtctccttcgtgggagaagtggagtggcacagttaaggcgactacaaggagttccccctaccctggagggagacttgcgggcgcgggacgccttgtctacgtgagcgtctcttcccaagtagacgactccctcgactttgtcccctccgtcgcattccgcccctctccgccctcctttcgtgtacgtctctgcattgtacacttcctttcgcctgctttcccacgctcgcgcgcaacaacgtggacgcaccacatcgctcgctggagaagagagaaaagtggtgagtacgtgttccgctctttcccttctcccctccgctcgcgtcgcacctctccgcagctttaccgctctcttcccttccatcatccgcgtcgtgcaccacttccctcattttccgtgcggcagtagaaaatgcggttccgcatttataagcgcaaggtcttgatcctgacgctggtcgtcgccgcatgcggatttgtgctgtggagctcgaacggtcgccagcgcaagaacgaagcgctcgccccgccgctgcttgacgcggagcctgcacgaggcgcgggtggccgtggcggcgaccacccgagcgtggcggtgggtatccgccgcgtatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 179 - DNA, 4717 bp, Artificial Sequence
  pLMTB8389
ggcgtgtgcgcaccggcgtgtgccaacgcccaggtactgtgcgcacgttcgtatctccatacgctagctgaccgagacgcatgccctccgccaccctcagtggcgcgcaccttctctcgtttgagctctttatgctctcgtgaatggcacacaacatcccgtgactatcacgatgatccttctcaagccacaccgcttgccttttctacagctctgcgttctctggcccatcctcctcttgtttgctttccctctttgcacatccgtgtgcgcgtccttgttcttctcttctgcgcacactattctgcgcccgcgacccgcgcttcgactgctgtcgggtcatgccttgtgctgcgcgttcagctcttcattgcccctcggccttgtacatagcggctctccgtcatcgacgttttcctctctcttcagctctatacactccctcccttgtcaacacactacactgtgtctccccctttcatctctcctcccctgtcacaatggtccgcaagaagggatctctgatcctgtgtggggcgtttctgttcgtggcctggaacgcgctcttgctcctttttttgtggggccgcccgcccattggtcgactcggcgagggtgggggggcggagccgggcgcgggcgaggagtggggtgcggggaagagcaaagtgggtggcgctaacggcctggcgggtgaggttatccgcctggcggaggaggtcgagagtgagctggagacgcagaagaagcttctgaaacagatacagtcgcaccgcgagctttgggaacagcgtaaggaactggagaagcgtgaaagcgaggataccaaggacgagaagattgacgttgagcctaagaagccccgccagatcccggccgtgcacctgtcccacaaggtggtggaagacgcccagacagtaaccaagaaaatgcaaacgctgatggtgacaccgcctcagctggtgatgaaggagcaggagacagatcagaagaataagcagatgatggaggaccagctggggctcaccacgccatctccgcaaatcatcatcccgattctcgtgatcgcgtgcgatcgcgtgaccgtgaagcggtccctcgaccgtctgatccagtaccggccaagcgcagagttgtacccaattatcgtcagccaggattgtggccacgctgacacagcccgcgtgatcgggtcctatggcagccagatcacgcacataagccagcctgaccttgcagatataccggtgcggccagatcatcgcaagtttcaggggtactacaagatcgcccgccattaccgttgggcgctcaaccaggtgttcaacgtgtttgcctactcaacggtggtgatagtcgaggacgacctggaggtggcgcctgacttcttcgagtactttcgagctctctatccgatcttgcgctcagatcctaccttgtggtgcatttcggcttggaacgataacgggcgtgatggtctcgtggatcccgggaaggccgagctcctctaccgcacggacttctttcctggactgggttggatgttgcttaaggaggtgtgggcggaactcgaacccaagtggccaaaggcgttctgggacgactggatgcgacacccggagcagcgtaaaaatcgctcttgcatccgaccggaaattagtcggacgatcacattcggtcgtaaaggtgtgtccttggggcagttcttcgaccagtatctccgttacattaagctcaacactgaattcgtccctttcacgaagcacgacctcagctatcttgtgcgagagaagtacgatgttagctttgaaaaagatgtatactcggctcccctcgtaaaggtagaggagctgcagcacggcggcagccttaagggcagcggccccttccgagtacagtactcgagccgagacagtttcaaggtccttgcccgcaacctcggggtgatggatgacctgaagtcaggcgtgccacgcgccggttaccgcggcgtggtctcgttcatatctcgcggccggcgcatctacctcgcgccccctgagggttggacgaaatacgacgtgagctggagctaaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 180 - DNA, 4339 bp, Artificial Sequence
  pLMTB8391
ggcgtgtgcgcaccggcgtgtgccaacgcccaggtactgtgcgcacgttcgtatctccatacgctagctgaccgagacgcatgccctccgccaccctcagtggcgcgcaccttctctcgtttgagctctttatgctctcgtgaatggcacacaacatcccgtgactatcacgatgatccttctcaagccacaccgcttgccttttctacagctctgcgttctctggcccatcctcctcttgtttgctttccctctttgcacatccgtgtgcgcgtccttgttcttctcttctgcgcacactattctgcgcccgcgacccgcgcttcgactgctgtcgggtcatgccttgtgctgcgcgttcagctcttcattgcccctcggccttgtacatagcggctctccgtcatcgacgttttcctctctcttcagctctatacactccctcccttgtcaacacactacactgtgtctccccctttcatctctcctcccctgtcacaatgcgcctccgcgaacccctcctgagcggctccgcagcgatgcctggggcttcgctgcagcgcgcctgtcggctgctcgtagcggtctgcgcactccaccttggcgtgactctcgtctactatctggcgggacgagatctgtcgcgcctcccacagctcgtgggtgtgtcgacgccgctgcaaggaggctcaaattcggccgcggccatcggtcagagctccggcgagctgcgcacgggaggagcacgcccgccacctccgctgggtgcatcgtctcagccccgtccgggcggcgacagttcaccggttgtggactcgggtccaggacctgcatctaaccttacgtccgtgcccgtaccacacacgacggctctttcgcttccagcctgtcccgaagagtcccctctgcttgttggtccgatgttgatcgagttcaacatgcctgttgatctcgaattggtggcaaaacaaaacccaaacgtgaaaatgggaggccggtacgccccgcgagattgcgtgtcgcctcacaaggttgcgatcatcatcccctttcggaatcgccaggaacaccttaagtactggttgtactacctccaccccgttttgcagcgccagcagttggattatggcatctacgtcattaaccaggccggtgatacgatttttaaccgcgccaagctgctcaacgtgggttttcaggaggcgctcaaggactacgattacacgtgcttcgtcttttccgacgttgatttgattcctatgaacgaccacaatgcgtatcggtgtttcagccagccgcgccacatttcggtagccatggataagtttggattctccctgccttacgtacaatacttcggcggcgtgagcgcattgtcgaagcaacagttcctgacgatcaacggctttccaaacaattactggggttggggcggggaagacgacgacatcttcaatcgtctggtgtttcgtgggatgtctatttcccgcccgaacgcagtcgtcggtcgctgccgtatgatccgacattctcgtgataagaagaacgagcctaacccacagcgcttcgaccgaatcgctcatactaaggaaacgatgctctccgacgggctcaactctctcacataccaggtcctcgacgtgcagcgctatccactttacacgcagattacggtcgacatcggcaccccgtcgtgaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 181 - DNA, 4379 bp, Artificial Sequence
  pLMTB8392
cgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagctagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaatgatgtcccctgaagatgcgaccgggctggaggctgcacgcaagcagaagatccataacctgaagctgaagacggcgtgcctagagaatgaggagcttgtgcaggagctgcacatctctgactggtcagagacgcagcgacagaagctgcgcggcgcccatgagaagggcgaggagctgcttgcgtccgtggaggttgggacgaagtggaacctgatggaggcgtacgacctggcgaagctgatgcgcgtgtgcgggctggagatgagtcagcgcgagctgtaccgcccggaggacaagccgcagttcatggacatcattggcgtgaagaaggtgctacaggaccttcgacagaaccggaacaagacgcgcgttgtgagcttcacgcagctgatcgacaacagcatcgcgaagatggagaaggtggaggaggagctgcggcggtcgcagctggacgcgacgcagctcgcgcaggtgccgtctcggacggtgaagatgatatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 182 - DNA, 4174 bp, Artificial Sequence
  pLMTB8564
aacacttgatcatcaatgcgcaatgtgcgcgtgttgtgtgtgtgtgtgcgagcgcacacacacatgcacacgactcacgttgtcacacaattgagagctctctcttctccttcccctctctctcctctctcctctctccagagctctctcttctccttcccctctctctcctctctcctctctccagagctcgagccaccatgcgcctgaatgttaagaaggcgcttatatttgttggatgcgtcgtgttcctctgggtccttctgagctacgcgagcgtcattgaagtgcctcgtgcagtcccccagaaagacccggccgtcgaaatcgaaaagaagatcatcaagcttcaaaagcaggtcgatgcacaaatggcggagtccaagagcttgctcgccaaggtgaagaaactgaagaagatcagtgagggagagaacgttggcggcgaggaggactcgctgaaggacagtgaggttatgcagcacctgtctcagccgatcctccccgttctggtgattgcctgcgaccgcgtcactgtgcagcgttgtttggacaacctggtgaagttccgcccctcgaaggaaacgttccccatcattgtttcgcaagattgtggccacaacgcgacctatgaagtcattacgtcatacacggcctccgacccgactatctctgtggtgcgtcagcctgatttgagcgaaatcgtcctcccccgcgtgaaggtgaagttccgcggctattacaagattgctcggcactacaaatttgcccttaaccacgtttttgagacccttggccacgaggcggtgatcatcgtggaagacgacctggatatcagtccagatttctttgagtacttcctggggacgtacccgctgcttttgaaagacccgtccttgtggtgcatctcggcgtggaacgacaacggtaagatggaggtcatcgacatgtcgcgcccggacctgctgcaccgcaccgacttctttccgggccttggctgggtcctgcgccgcgaaatgtggcgtaagcttgctccaaaatggcccaccgcgttttttgacgactggctgcgaaacccggttaacatcgacggcaaggcctgcatccgcccagagatatctcgtacctatagtttcgggaaggtgggtgtgtctaagggactgttcttcgatcttcacctccgcaacattcagctcaatatggaatacgtcgaatttacgaaactgaacctcacatacctgcttaaggaacactacgacgatgccctcgtctccaccgtttacaatctgccggagatgagtgcatccgaggtggttgcaggcagcgatctcagcgcagacccggtgcgtgttatgtactccaatgccaagacatatcagcgcgccgcgaaaaagctcggcctgatggacgacttccgctccggggtaccgcgcacggcctaccgcggcatcgtgacgtgtttcattcggggccgacgagtataccttgccccgtcgtttgagtggaacaagtacgacccgacctggggatagatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 183 - DNA, 4217 bp, Artificial Sequence
  pLMTB8568
atggtgcggaagaaagggagcctgatcctttgcggcgcgttcctctttgtggcatggaatgccttgctgctgttgttcctttggggccgccccccgatcgggcgcctcggtgagggcgggggcgccgaaccgggcgccggagaagagtggggcgctggaaaatcaaaggtgggcggcgccaatggtctggcaggggaagtcatccggctggcggaagaagtggagagtgaactcgaaacgcagaagaagctgctgaagcagattcagtcgcatcgcgagttgtgggagcagcgcaaagagctggagaagcgcgagagcgaggacacaaaagacgaaaagattgacgttgagccaaaaaagccccgtcaaatccccgcggtacacttgtcccacaaggtcgtggaggatgcccagacagtgacgaagaagatgcagacgttgatggtaaccccgccccaacttgtcatgaaggaacaggagacggaccagaagaataagcaaatgatggaggaccagttgggcttgaccaccccaagtccgcaaataatcattccgatcttggtgatcgcgtgtgaccgcgtgactgtcaagcgaagcctggatcgcctcatccagtaccgcccaagcgctgagctctacccgatcatcgtgtcccaggactgcggtcacgcagacaccgctcgcgtgatcggcagttatggctcacagatcacacacatctcccagccggacctcgccgatatccccgttcgaccggatcaccgcaagttccaggggtattacaaaattgcacgccactatcgctgggcactcaaccaggtgtttaatgtgtttgcgtacagtaccgtggtgatcgtcgaggacgaccttgaggtggccccggatttcttcgagtactttcgcgcgctgtaccccatcctgcgttcagaccccacactctggtgtatctcagcgtggaacgataacggccgggacggtctggtggacccgggtaaagcggagcttttgtaccgtacggatttcttccctggcttgggctggatgctgctcaaggaggtgtgggcggagcttgagcccaagtggccaaaggctttctgggacgactggatgcgccacccagagcaacgcaaaaaccgcagttgcatccgcccggagatcagccgcacgatcacatttggccgtaagggtgtatcgctcggtcagttctttgatcagtacttgcgctacattaaactcaacacagagttcgtccctttcacaaaacatgacctgagttacctggtccgcgagaagtacgacgtgtcgttcgagaaagacgtctactctgcccctcttgtgaaggtggaggagctccagcacggtgggagtctgaagggtagcgggcctttccgcgtccagtactcctctcgtgattcgttcaaggtgcttgcacggaacctgggggtcatggacgacctgaaatcaggcgttccacgcgccggataccgcggggtcgtgagttttatctcgcgaggccggcgcatttacctggcacccccggagggctggacgaagtacgacgttagctggtcttgaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 184 - DNA, 3989 bp, Artificial Sequence
  pLMTB8582
atgctcaagaagagcagcctcgttctttggggagttgtattgtttgtggcatggaatgctctgatactgtttttcctgtggacgcgtcctcagagcctgtccgaccactcgcacctgaccgaggaggtgatccgcttggcccaggatgcggaatcggagctggagcgtcagaaggatctgcttcagcagatctaccgatacagcgcgctctggtcacggcgtaaggcctctgaggcgaagctgcacccgccagtggcagcttccgctcagcctagcacggccgccccgctttcacaccactcgcaaatttcccctgacgctgttctgcctgttcttgtgatagcatgtgatcggagtacagtgcgccggtgcctggacaaactgctgcactatcggccgagccaggagcgcttccccattattgtgtcgcaagactgcggtcacgacgagacggcccgagtgatcgcatcatacggcgatgctattatgcatatcaagcagccgaacttgagcgacattcccgtgccaaccgatcaccgcaagtttcagggttactacaaaattgcccgtcactatcattgggccctttctcaggtcttccgtacattccagtatcaggcggcaatcgtggttgaggatgaccttgaggtggctccggatttctttgaatactttcaggcggcctttcctctgctgctggccgacccgacattgtggtgcgtgtcagcctggaacgacaacgggaaagagcagatggtggacgccgctcaccctgatctcctttaccgcacggactttttccctgggctgggctggcttctgcttagcgatctttggaatgaactcgaaccgaaatggccgaaggcgttctgggacgattggatgcggcagccagagcagcgtcagggccgttcatgtatccgccccgaggtgagccgaacgatgacatttggtcgcaaaggtgtgagtcatgggcagtttttcgatcaacatctcaagtttatcaagctgaatgaccactttgtgcccttcacgcagatggacctgtcatacctgaagaaaaacgaatacgatcgtagcttcctggaccaggtgtatggggccccagagttgcgcgtggaagagctgcagggtaatcgccgccgagagctcggaacggtgcgagtgcaatacacgactcgagactccttcaaggcattcgcgaaggctctgggcgtaatggatgacttgaagtccggcgtcccacgtgccggttatcgcggcatcgtcagttttctttaccagagccgacgtgtgtacctggcacccccgagcgactggactggctacgacccgtcctggagttgaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 185 - DNA, 3995 bp, Artificial Sequence
  pLMTB8608
atgcgcttccgcatctacaagcgaaaggtggtgatactcacgctcgtcgtgataatttgcggcttcgccgtgtggaactccggcaaaccgaagaaggctagcacggtgtttccaaaggaagtggaaactgtgaagcgctcgagcgtggggtctcaaatccaggccacaatcccggtgacacgcaagccgatcaatgagtcgattcccgagaagcaacaacagcaacaaccagtagccaagtccgaggcagacaacacgacgctcgtctaccgcggcatcgtgttccagctgaatttcgaccaaaatcttaagaacgaggagaagtttcgggctgtgcgccagaaggatgatctggtgatcgttgttcaagtacacaaccgtccggagtatctccgccttctcgtggactcgctgcggaagtccaaggggatagagaacattttgctgatctttagccacgacttctggtcgccggagatcaatcagatcgtggccagtgtggacttctgtctggtgctccagatattcttccccttctcaatacaactctacccgcaggagtttccagggaacgatccacgagactgtccgcgggacattccgaagaaggaggcgttgaccctgggctgtataaacgccgagtaccctgacagcttcggccactatcgggaggcaaagttctcgcagacgaagcatcactggtggtggaagcttcacttcgtctgggatcgtgttcgagtattgaaggatcataaaggccttgtgctgctgattgaggaggatcactacctggccccggatttttatcatctcttgaagctgatggcatccttgaagaaagagcaatgtccagattgcgacatcctgtcactcggcagctacggccatataggatacagctccaaggcaaacaaggtagaggtgaaggcttggaagtctacggagcacaacatgggcatggccttgaaccgcgacgcgtaccagaaactgctgcggtgcaccgatgccttctgtacgtacgacgattataattgggactggagtctccagcacttgactgtgacgtgtctgcctgcgttcttgaaggtcatggtcagcgaggcccctcgcatcttccatgccggcgactgcggcatgcaccataaaaagagtgcatgcatgcccagcggtcaaaaaacgaaaatcgagaacgtacttcagaactcgggcaaccagctgtttccaaagcaacttctgatcaccaagcgcttgccagcgtccggggcgaagggcgtcgctcctcatgttaaaaacggtggttggggcgacatccgggaccacgaactgtgtaagtcgtacctccggctccagtgaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 186 - DNA, 3455 bp, Artificial Sequence
  pLMTB8631
gcttggcgaggtgcgtgtccagtatacgtcccgcgacagctttaaggcatttgctaaagccttgggtgtcatggatgatctgaagtctggcgtgccccgtgcaggctaccgtggaatcgtgaccttccagttccggggtcgccgggtccacctcgccccgccggagacctggaacggctacgacccgtcctggaattgagtgactataaagtgctattgaatttttttttcttttcctttcacgaaacaaaaatctgtgtgtgcgcattttcttactctccatttggtgcgcacccttctgggggtatgaccttcagcacacacaaagaacgtgtgctgcgcatatgtgttcaatgcatgtgcttttcctctctttgtttctatcaaggaggttcatatgagagggcatgctcacagcagcttcccttatgcatatgtagccttctgagttcagatgtgatactgctcccttgatctcccttttgtgtttttgttcgaaacaacaatgacgctcttacattctctctacctattatcgtttctttcgcatctgaaagcgtggtactagttagctttatcttagtaaaacagttaccattcactgccaccaaaaatgcggtttcggatctacaagcgcaaggtattgattcttactctcgtggtggcggcgtgcggctttgtgctgtggtctagcaatggccggcagcgtaagaatgacgcgttggctccgccgctgttggacagcgagccgcttcgcggggcgggccattttgccgcttcggtgggcatccgtcgtgtgtctaacgattcagcatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 187 - DNA, 3971 bp, Artificial Sequence
  pLMTB8632
atgcggtttcggatctacaagcgcaaggtattgattcttactctcgtggtggcggcgtgcggctttgtgctgtggtctagcaatggccggcagcgtaagaatgacgcgttggctccgccgctgttggacagcgagccgcttcgcggggcgggccattttgccgcttcggtgggcatccgtcgtgtgtctaacgattcagccgcgccgctcgtgccggccgtccctcgtccggaggtggacaacctcaccttgcgataccgcagcctggtctaccaactcaatttcgaccagatgctgcgcaacgtagataaggacgggacatggtcgcccggcgagctggtactggtcgtgcaggtgcacaatcgtccagagtacctgcggctcctgatcgactcactgcgcaaggctcagggcatccgggaggtgctggtgatcttttctcacgacttctggtccgctgagattaacagcctgataagctctgtggacttttgcccagtacttcaggtattctttccattcagcattcagctgtacccctccgagtttccgggtagtgacccgcgcgattgcccgcgcgatctcaaaaagaatgccgcattgaagttgggctgcatcaatgcggagtatccagacagcttcggccactaccgtgaggccaagttctctcagacgaaacaccattggtggtggaagttgcatttcgtctgggagcgcgtgaaggtcctgcaggattacacaggcctgattctgttccttgaggaggatcactacctggcgcccgacttctaccatgtgttcaagaagatgtggaagctgaaacaacaagagtgccctggttgtgatgtgctcagtctcgggacctacaccaccattcgtagtttctacggcatcgctgacaaggtggacgtgaagacatggaaatcgacagagcacaacatgggtctggcattgacacgggatgcgtatcagaagctgattgagtgcaccgacacattctgcacgtacgacgattataactgggactggacgctgcagtaccttacgctggcgtgccttccgaaggtatggaaggtcctggtgccgcaggccccgcgaatcttccacgcgggtgattgcggcatgcaccacaagaagacgtgccgcccttccactcagtcagcccagatcgaaagcctgctcaataacaacaaacagtacctcttcccagaaaccctcgtgatcggcgagaagttccctatggcggcgatctccccgccccgtaagaacggggggtggggcgacatacgtgatcatgagctctgtaagtcgtatcgccgcctccaatagatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 188 - DNA, 4186 bp, Artificial Sequence
  pLMTB8633
atgcggttccgcatttataagcgcaaggtcttgatcctgacgctggtcgtcgccgcatgcggatttgtgctgtggagctcgaacggtcgccagcgcaagaacgaagcgctcgccccgccgctgcttgacgcggagcctgcacgaggcgcgggtggccgtggcggcgaccacccgagcgtggcggtgggtatccgccgcgtgtcaaacgtctcagccgcatcattggtgccagccgtgccccagccagaggcggacaacctcacattgcgctaccgatccttggtctaccaacttaactttgaccaaacgttgcgcaacgtcgacaaggcaggtacttgggctccacgcgagcttgtgttggtcgtccaggtgcataatcgtccggagtaccttcgcctcctgctggactcccttcgcaaggcacaaggcatcgacaacgtgctggttattttcagccacgacttttggtccaccgagatcaatcaacttatcgcgggcgtgaacttctgtccagtgctccaggttttcttcccgttctccatccagctgtaccccaacgaattcccaggatccgacccgcgagactgtccacgggacctcccgaagaacgccgctttgaagcttggttgcattaacgcggaatacccggatagcttcggtcactaccgagaggccaaattctctcagacgaagcaccactggtggtggaaattgcacttcgtgtgggaacgtgttaagatcctgcgtgactacgccggcctcatattgttcttggaggaggaccactacctcgcccccgatttttaccacgtgttcaagaaaatgtggaaactgaagcagcaggagtgtcctgagtgtgatgtgctgagtctcggaacctactcagccagccgctctttctacggcatggccgacaaggttgacgtgaaaacctggaagagcactgagcacaatatgggtctggcacttacgcgcaacgcgtaccagaagttgatagagtgcaccgacacgttctgtacgtacgacgattataactgggactggacgctccagtacctgaccgtgagctgcctccctaagttttggaaagtgctggttccgcagatcccacgtatcttccacgcaggggactgcggcatgcaccacaaaaagacgtgtcgtccatcgacgcaatctgcccaaatcgagtcgcttctgaacaataacaagcagtacatgtttcccgaaacgctcactatctcggagaagtttaccgtcgtggccatatcaccgccacgcaagaatggcggctggggcgacatacgcgatcatgaattgtgtaagtcgtatcgccgcctgcagtgatcagcgttccgtagcgcgctgcacatccggtactgcgttccagcgcatcacgcgacgcacagcaacacaaattttcgttttgtttctcttccattcgaaaaaaaaaagataacacccaccccacttaacctccataacaagagagcgtgagaggagagtctgctcttggccttcacaccgcaaatgcagcaaaacgcggcatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 189 - DNA, 3993 bp, Artificial Sequence
  pLMTB8698
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtacccgggggcagcggtgttggcggaacggccaacgccctgccccctccccgccctgcgacgtttctgcgcacccgttctctccttcctgcgtgcgtgtctgcgcgcatgcacatctgtccgcgtgtgccgcagcgctggtatttttgtgagggcagagccctgcctccccgcctctctgccgttggcaggtgaagcgaaaacgaagcgagagggcagtctgcatgtgtgtgcgagggcatgcggagcccccctccccccgccccctgccgtgctgcaccgctattgtggcgtcttctctcgttgtgcgcaagtgtggctgcaccacggccgcctcatgtgcgtgtgtgcgcatgtacacacacacacacacacacacacacacacgggcaggcgcacgctcctctctcttcagggagcgccgccccgctggtgtcattggacgagcatccgccgcgcatctcttcacccctcacccctcatccctctcccctctccccgcacacacacgcagtccttcgctttcactcttcgaacaaacacctcaaccatcttatcacctttctctcttccttgtcaaccatgatcgcgagcagcgtgcgccacgcggtgatcctgctgctggtggcggtggcgatgatggtgaacaacgtgatcgcggaggtgcagctggtggagagcggcggcggcctggtgcagccgggccgcagcctgcgcctgagctgcgcggcgagcggcttcacgttcgacgactacgcgatgcactgggtgcgccaggcgccgggcaagggcctggagtgggtgagcgcgatcacgtggaacagcggccacatcgactacgcggacagcgtggagggccgcttcacgatcagccgcgacaacgcgaacaacagcctgtacctgcagatgaacagcctgcgcgcggaggacacggcggtgtactactgcgcgaaggtgagctacctgagcacggcgagcagcctggactactggggccagggcacgctggtgacggtgagcagcgcgagcacgaagggcccgagcgtgttcccgctggcgccgagcagcaagagcacgagcggcggcacggcggcgctgggctgcctggtgaaggactacttcccggagccggtgacggtgagctggaacagcggcgcgctgacgagcggcgtgcacacgttcccggcggtgctgcagagcagcggcctgtacagcctgagcagcgtggtgacggtgccgagcagcagcctgggcacgcagacgtacatctgcaacgtgaaccacaagccgagcaacacgaaggtggacaagaaggtggagccgaagagctgcgacaagacgcacggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 190 - DNA, 4834 bp, Artificial Sequence
  pLMTB8803
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaatggtaccaaattggataacttggcgaaacgccaagctaatacatgaaccaaccgggtgttctccacttcagacggtgggcgaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagcttgtgatggccgtgtagtggactgccatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgtccctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccatgatcgcgagcagcgtgcgccacgcggtgatcctgctgctggtggcggtggcgatgatggtgaacaacgtgatcgcggacatccagatgacgcagagcccgagcagcctgagcgcgagcgtgggcgaccgcgtgacgatcacgtgccgcgcgagccagggcatccgcaactacctggcgtggtatcagcagaagccgggcaaggcgccgaagctgctgatctacgcggcgagcacgctgcagagcggcgtgccgagccgcttcagcggcagcggcagcggcacgaacttcacgctgacgatcagcagcctgcagccggaggacgtggcgacgtactactgccagcgctacaaccgcgcgccgtacacgttcggccagggcacgaaggtggagatcaagcgcacggtggcggcgccgagcgtgttcatcttcccgccgagcgacgagcagctgaagagcggcacggcgagcgtggtgtgcctgctgaacaacttctacccgcgcgaggcgaaggtgcagtggaaggtggacaacgcgctgcagagcggcaacagccaggagagcgtgacggagcaggacagcaaggacagcacgtacagcctgagcagcacgctgacgctgagcaaggcggactacgagaagcacaaggtgtacgcgtgcgaggtgacgcaccagggcctgagcagcccggtgacgaagagcttcaaccgcggcgagtgctaactcgagggaggaggaggaggcgcgtagcattgcgtgcgggttatgtgtgcgtgcgtgtgtgtgtgcggtgcgcgcctttcctcttttttttctccctctcgtcggttttttttttctgaggagacggggcgaagacgcgagcggggggcggcgtttgtgtgtgtgtgtgcgcgtgtcgggggcagcggtgttggcggaacggccaacgccctgccccctccccgccctgcgacgtttctgcgcacccgttctctccttcctgcgtgcgtgtctgcgcgcatgcacatctgtccgcgtgtgccgcagcgctggtatttttgtgagggcagagccctgcctccccgcctctctgccgttggcaggtgaagcgaaaacgaggtaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 191 - DNA, 4065 bp, Artificial Sequence
  pLMTB8821
gcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaactagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaatgatgtcccctgaagatgcgaccgggctggaggctgcacgcaagcagaagatccataacctgaagctgaagacggcgtgcctagagaatgaggagcttgtgcaggagctgcacatctctgactggtcagagacgcagcgacagaagctgcgcggcgcccatgagaagggcgaggagctgcttgcgtccgtggaggttgggacgaagtggaacctgatggaggcgtacgacctggcgaagctgatgcgcgtgtgcgggctggagatgagtcagcgcgagctgtaccgcccggaggacaagccgcagttcatggacatcattggcgtgaagaaggtgctacaggaccttcgacagaaccggaacaagacgcgcgttgtgagcttcacgcagctgatcgacaacagcatcgcgaagatggagaaggtggaggaggagctgcggcggtcgcagctggacgcgacgcagctcgcgcaggtgccgtctcggacggtgaagatgatatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 192 - DNA, 3677 bp, Artificial Sequence
  pLMTB8831
cagtcgtcggtcgctgccgtatgatccgacattctcgtgataagaagaacgagcctaacccacagcgcttcgaccgaatcgctcatactaaggaaacgatgctctccgacgggctcaactctctcacataccaggtcctcgacgtgcagcgctatccactttacacgcagattacggtcgacatcggcaccccgtcgtgagtcctccggcttgacagcgcacacgcgccgctgtatgtgcgcgtgcgcgcgggtcccgactggggccggcgatgaggcgcatcatacctccatagagaccctattttttgttttatggcttctcagatgaccacttggtttcttccttccttcgtttggtttgtttatctcctccccttcgttgagggtacgagtcagggtaggctcggacaaaacttaccgcacccgcgatgggccacagctgtctatcgctctcgctctctcggtctcctgaccgggacaggttgtcgccccgtcacgcgtaccggcgtgcgcgcccgctcttgcgccctgccccaccattcgtcgaatgatgcgcgacgcgcatgacaggcgctgctgcagcactgctccctgcggttgctgagtgcgtacatggcgttgctactgatgtgtttgcactgcatctcacctcgctctcttcacgcatccgctcgcccttcttccctcttcacgagactgcgtcggtcttttggtgctgctgtggcgcagcccgccgccttccactccccccaaacacacacgttcatacgtccacacagcactcgtgcgcaccgacacacccacaccccctcctctctctcctctccccaaccatgcggctccgcgagccactgctgagcggctcggcagctatgccgggcgcgtccctgcagcgtgcgtgccgcctccttgttgcagtatgcgccttgcacttgggcgtgaccctcgtgtactatctggcgggccgagatctgagtcgtctgccgcaactggtcggagtgagcactccgcttcaaggcggatcaaacagcgcatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 193 - DNA, 3839 bp, Artificial Sequence
  pLMTB8832
atgcggctccgcgagccactgctgagcggctcggcagctatgccgggcgcgtccctgcagcgtgcgtgccgcctccttgttgcagtatgcgccttgcacttgggcgtgaccctcgtgtactatctggcgggccgagatctgagtcgtctgccgcaactggtcggagtgagcactccgcttcaaggcggatcaaacagcgccgcggccatcgggcagtcttctggtgagcttcgcaccggcggagcccgccctccacctcccttgggcgcctccagccaaccccggccaggcggggactccagtcccgtggtagattcgggccccggccctgcttccaacctcacatcggtgcctgtaccccatacgactgccctctcattgccagcctgtccagaggagagcccgcttctggtaggcccaatgctgatagagttcaacatgccggtcgacttggaactggtggctaaacaaaacccgaatgtgaagatggggggccgctatgcgccgcgggactgcgtgagcccgcataaggtggcgattatcatcccgttccgtaaccgccaggagcacctcaaatactggctctactaccttcatccggtactgcagcggcaacagctggactacgggatctacgttatcaaccaggcaggggacacaatattcaatcgcgctaagttgctgaacgtcggatttcaggaggcgttgaaggactatgattatacctgcttcgtattctccgatgtcgacttgatcccgatgaacgatcataacgcctatcgatgcttctcccagcctcggcacatcagtgtggcgatggacaagttcggcttttccctcccatacgtccagtatttcggtggggtgagcgcgctgtcgaagcagcagttcctgacaatcaacggcttcccgaataattattggggttgggggggggaggatgacgacatttttaatcgcctcgtctttcgggggatgtcgattagccgaccgaatgccgtggtcggtcgatgccgtatgattcggcattcgcgtgacaagaagaatgaaccaaatccccaacgcttcgaccgaattgcgcataccaaggagacaatgctgtcggacggccttaacagtttgacataccaggtcctggacgtccagcgatacccactctatactcagattacagtcgacatcggcacgccttcgtgaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 194 - DNA, 3661 bp, Artificial Sequence
  pLMTB8834
ccgtggtcggtcgatgccgtatgattcggcattcgcgtgacaagaagaatgaaccaaatccccaacgcttcgaccgaattgcgcataccaaggagacaatgctgtcggacggccttaacagtttgacataccaggtcctggacgtccagcgatacccactctatactcagattacagtcgacatcggcacgccttcgtgagcctgtgtgctgcctcctcatttccggcggctcgcacgcgctcgcatgcttcgccacacagacgtcctcgtgtctactgaacagctaacggatttccatgtcatttctcgtttcccatcttcaaacacaagagcaccactgcaacgtcagcagtgaacgcccaacactgcggagagcgtggtcacgccccttctgacttgcaccatgaaaaacgatgtgaggcagcggcgcgtcctctctcccgttcgctgacttgccccacgcgagtatctgcgcgccggcacccctctccgcagctcggtttgcctgcaggtgtgcgctctcgatacctcccgcctctgtcattctgtttgtctcttcctcccagctccactcttcttcttttcctgcttctccgtttgtttgtgcggcgcagtgccgcgaccagcacattttggctctctctccgttgctagcaccaggggtcgggatcgacgtgcgcgttgctcctccgctctccccattttcatctccttattctgctttgttttgcaaactcgccggcgaacgctgtcaaatcttcacgggttgtttttctctcttcctctctcgtggaacgccggcgtgccaagacgaggccatgcggctgcgcgaaccactcctgtcgggaagcgccgccatgcctggcgccagcctgcagcgcgcctgtcgtctcttggttgcggtgtgcgccttgcatcttggggtgacgttggtctattacttggccgggcgcgacctctcccgtctccctcaacttgtgggcgtctctacccctctgcaaggcgggagcaatagcgcatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 195 - DNA, 4039 bp, Artificial Sequence
  pLMTB8836
atgcggctgcgcgaaccactcctgtcgggaagcgccgccatgcctggcgccagcctgcagcgcgcctgtcgtctcttggttgcggtgtgcgccttgcatcttggggtgacgttggtctattacttggccgggcgcgacctctcccgtctccctcaacttgtgggcgtctctacccctctgcaaggcgggagcaatagcgcggctgcgattgggcagtcttccggggagctgcgcacgggcggggctcgcccgccgccaccgcttggcgcatccagccaaccacggcctgggggcgactcaagcccagtcgttgactcgggccctggtccggcctccaaccttacgtcagttcctgtcccgcacacaactgcgctctccctgccagcctgcccagaagagtcgccgctccttgtcgggccaatgcttatcgagttcaacatgccagtcgacctcgaactggtagcgaagcagaaccctaatgtgaaaatgggtggacggtacgcacctcgagactgcgtatccccgcacaaggtagctatcatcatccccttccgaaatcggcaggaacatcttaaatactggctgtattacctccatccggtccttcaacgtcaacagctggactacgggatctacgtgattaaccaggcgggcgacaccatcttcaaccgcgcgaagctgcttaacgtggggtttcaggaggctctgaaggattacgactacacttgctttgtgttcagtgacgtcgacttgatcccaatgaacgatcacaacgcatatcgctgcttctcacagccacggcacatcagtgtcgcaatggataagttcggcttctctttgccctatgtacagtactttggtggcgtgagtgcactctcaaagcagcagtttcttactattaacggcttccctaacaactactggggctggggcggggaggatgacgatattttcaatcgtctggtgttccgcggtatgtcgattagccgcccaaacgcagtggtcggccgctgtcgtatgatccgccacagtcgcgataagaagaatgagcctaatccacagcgattcgaccgtatcgcgcatactaaggagactatgctttcggacggattgaattccctcacctatcaggtgctcgatgtgcagcgctaccctttgtacacccagatcactgtcgacataggtacaccttcctagggtagactcgtgccgcgcgctgatgatgtaggtgcacgcgtgcgtgtgctgcagcggagccgccgccaccgcgactgtgtgtgtgtgcgcgcgtgacgaccggctcgaggaaggaggagcgcgcgtgtgcgtgcgatgcgcctcctctttttttttcgccctcgtcggtttttttttttctgagaggacggcggcggcggatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 196 - DNA, 3434 bp, Artificial Sequence
  pLMTB9070
gcgcagacccggtgcgtgttatgtactccaatgccaagacatatcagcgcgccgcgaaaaagctcggcctgatggacgacttccgctccggggtaccgcgcacggcctaccgcggcatcgtgacgtgtttcattcggggccgacgagtataccttgccccgtcgtttgagtggaacaagtacgacccgacctggggatagacttttgatggcactgtttttctttacttttatttctctcaaaacatcagaagcagtaatgtaaatattcattttgtttcagcgctcgtgccaaacatcacgcgcttgttcaagaggctatgcgaagtgatcattgccgttttttttttcctcagcgtaagcggtgcatatgctcaaaatgcatgtgcttgtggaaaatcaaggcaactttgcatctcctgttgagagttctagtccagcaatctatccatggccttttcttctttgggatacttttatcgcgatgctttgcgcttcgtctctaccccttctgtatcctacaaaaatatcataacgccgattatgtgctcgatgcgctgcttcgaatagctctgttttcttcatttaacacgatggtgcggaagaaagggagcctgatcctttgcggcgcgttcctctttgtggcatggaatgccttgctgctgttgttcctttggggccgccccccgatcgggcgcctcggtgagggcgggggcgccgaaccgggcgccggagaagagtggggcgctggaaaatcaaaggtgggcggcgccaatggtctggcaggggaagtatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 197 - DNA, 3927 bp, Artificial Sequence
  pLMTB9072
gtagcgggcctttccgcgtccagtactcctctcgtgattcgttcaaggtgcttgcacggaacctgggggtcatggacgacctgaaatcaggcgttccacgcgccggataccgcggggtcgtgagttttatctcgcgaggccggcgcatttacctggcacccccggagggctggacgaagtacgacgttagctggtcttgaagagggcgtgcctggggagagggagacattggcggcccaggtggtgcgtgtgcgcggatctgcgtgcagaggtgcgcagggcgcgcgctctcgtcttttggtctctttctgttttcgctttatttctgtttttttctccttttcaacagcaagaacagccaccacgcgcaccaagcgaaggtaacgtgagactcggcttgtgggattgcttcggtgcgcggggggggaacggcgaggaggtggggtggtgggtggggacctcccctcatctgcctcctgcgcagcaccccatcactcacgcgcacacagatgagcaagtccgccgacgcactgcaggccacccaactgtgcttcgtgttgctcgtgcatcgatctccctctgtgcaagcgaataggctctcctcagatcagatgtgattttcgttcccctccacatcacttcctcgagcagctgacctttaccatgtcttcgcaggcgatgacggcgcccactaggcctcgccccctccaccgctgttgccaacattgcaactgcttctctgtacttctctgtgtttctcgaactctcttccccctcccccaccgtttccatctccgcgcgtgtgcgcgtcgctgtacactcttcgctggatgccggatcccacgcaaacacacacgcacacacacacacacacatcagacgtgcctcacaaacccgttcgtgctcgaacatcgacagcgcacccagacgtgtggtcttgctcttcttcctttcgctcgttctcagctcttcttcctccttacccagtacgacgagctctgacctcttgtcgtgtgcccgcctgtgtgccatacacctggcacccactcctaaacacgcacttatcacacctccatcgcaacaccatgcgtttccgcatttacaagcgcaaggtcctcattctgacgctcgtcgtggccgcctgcggctttgtgctgtggtccagcaacggtcgccagcgtaaaaacgacgccctggcaccaccgctgctggattcggagcccctgcgaggtgctgggcactttgcggcgtcagtggggatccgccgggtgtcgaatgactcggcatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 198 - DNA, 3771 bp, Artificial Sequence
  pLMTB9077
gacgtgcacgcagtcctgtccccacccccgacagcaggagtgcgggactgggtgctctaacaagcgcatggtacgagctatgtgctggtgtgtagccagcggggctgtcatgccatgtcgatctctccccgtgagcagccccccaaaaagacaacctgatttctccctttttccgatatttctccctttgtgctaaggggacccttcagcagctcccagcgccgcacatgcacacactggcgcgtgcttccgaggtcctcggtgcacatattttctattatctcacacacccggttgcagggcggctcaatgtcacggcgcgcgcacgcactgccttgagtacggaacggcgagcgatacgaccgagacggcgctgccagtagggtgtaggacgctgcgcatctcatgaatgtatgaagcatgcagccaaccacacaaacatatgggcgcacgagtcttccctcacagacagcgcggctggtgaggcggcagaaggtcggccgcggaagggcacacactacgtttcacgcgtacatgaccccgtccgctttccgcgctattttaggcgcacacccgttcaccagcctctccgatcctgcttccactcctcctccgcctccgccctccctctccccgtcatgacgccgcacgcaccgcgatcgcacacaagctctctctctctctcaacacaaccgaaccaacatccctcaccccctctcttaccacaaaatgaccgagtacaagccgaccgtgcgcctggcgacacgcgacgacgtgccacgcgcagtgcgcacactggcggcagcgtttgcggactacccggcgacacgccacacagtggacccggaccgccacatcgagcgcgtgacagagctgcaggagctgttcctgacgcgcgtgggcctggacatcggcaaggtctgggtggcagacgacggcgcagcggtggcagtgtggacgacaccagagagcgtcgaggcaggcgcggtgttcgcagagattggcccacgcatggcggagctgagcggcagccgcctggcagcacagcagcagatggagggcctgctggcaccgcaccgcccaaaggagccagcctggtttctggcgacagtgggcgtgtccccggaccatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 199 - DNA, 3971 bp, Artificial Sequence
  pLMTB9080
atgcgtttccgcatttacaagcgcaaggtcctcattctgacgctcgtcgtggccgcctgcggctttgtgctgtggtccagcaacggtcgccagcgtaaaaacgacgccctggcaccaccgctgctggattcggagcccctgcgaggtgctgggcactttgcggcgtcagtggggatccgccgggtgtcgaatgactcggccgctcccctcgtaccggctgtcccccgccccgaggtggacaacctcaccctgcggtatcgctcgttggtttaccagctgaatttcgaccaaatgctgcgaaacgtggacaaggacggaacatggagtccgggtgaactcgtgcttgtggtgcaggttcataaccggccagagtaccttcgcctcttgatcgactcgctccgcaaggctcaaggaattcgggaggtgcttgtgatctttagccatgacttctggtctgcggaaatcaactcactcatttccagcgttgatttctgcccagttctccaggtgttctttccgttcagcatccagctctacccaagcgagtttccgggcagtgacccacgtgactgccctcgcgaccttaagaagaacgcagccctgaagctcgggtgcataaatgcagagtaccctgattccttcgggcactaccgggaagctaaattcagccagacgaagcaccactggtggtggaagcttcacttcgtgtgggagcgcgtgaaggtactccaggactacaccggcctcatcctgttcctcgaggaggatcactacctggcacccgacttttaccacgtgtttaagaaaatgtggaaactgaaacagcaggagtgcccaggctgtgacgtgctgtctcttggcacgtacaccaccatccgtagcttctacggcatcgccgataaagtagacgtcaagacttggaaaagtacagagcacaacatggggttggccctgacacgcgacgcataccagaagcttattgagtgtacagacacattttgcacgtacgacgactacaattgggactggactctgcaatacctcactctggcctgcctgccgaaggtctggaaggtgctggtgccacaggccccccgaatttttcatgccggtgactgcggaatgcatcataagaagacgtgtcgaccctctacccagagcgcccagattgagagcttgttgaataacaacaagcagtacctgtttccggagactctggtgattggcgagaagtttcctatggccgctatttcccccccgcggaagaacggcgggtggggggacatccgtgaccatgagctttgtaagagctaccgccgccttcagtagatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 200 - DNA, 3601 bp, Artificial Sequence
  pLMTB9082
ataagaagacgtgtcgaccctctacccagagcgcccagattgagagcttgttgaataacaacaagcagtacctgtttccggagactctggtgattggcgagaagtttcctatggccgctatttcccccccgcggaagaacggcgggtggggggacatccgtgaccatgagctttgtaagagctaccgccgccttcagtagggcacgcagtgtgtgtctcgtttgctccgaattctttttcctttttcgtttttcgtgtttcgcgtgcctctcttttcggcgcatgcgaaaaacagcacagcaatccagcaaacgaacaaagaaaatcatcgatggcgcacgctacgccaaggttgggggtggagcgggggtggcggcaacgccgtgtgcagcagagcagacacccatcgcagaagcccccggtatctgcgtgcatgtgtgttcggtgcacgaccgggtcgtgctgcttgtatgtttggggagggaggggctgcgttgccttcctcacgcctcccatccctccatccctgtcgccttctaggggtcgccgaggcgcgtgcagagacggactctacaggcccaggcgagatggcaacgggcgcacgcacacacgcacgcggagggaggaatgtttgggatgaatcacactgcactgaaacctctcttctaccctcatcagccttcatcttcactcgacacacagacgcgccgctgtcgccaccgcctcagaaaaggcagcaagcacacgtgaaaccctaaaatgcggtttcgtatttacaagcggaaggtgcttattctgacactggtggtggctgcctgcgggttcgttctgtggtcatcgaacggccggcagcggaagaacgacgcgctggctccaccactgctggactcggagccgctccggggtgccggccacttcgcagctagcgtcggaatccgtcgcgttagcaacgactccgcatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 201 - DNA, 4171 bp, Artificial Sequence
  pLMTB9083
atgcggtttcgtatttacaagcggaaggtgcttattctgacactggtggtggctgcctgcgggttcgttctgtggtcatcgaacggccggcagcggaagaacgacgcgctggctccaccactgctggactcggagccgctccggggtgccggccacttcgcagctagcgtcggaatccgtcgcgttagcaacgactccgctgccccgttggtacctgcagtcccgcgccctgaggtagacaacctgaccctgcgctatcgcagccttgtttaccagttgaacttcgatcagatgttgcgcaacgttgacaaggacgggacttggtcgcccggtgagcttgtgctcgtggtgcaagtgcacaaccgccccgagtacctgcgcctgctgatcgacagcctccggaaggcccagggtatccgcgaagttttggtcattttctcgcacgacttctggtcggcggagattaactcgctgataagcagtgtcgacttttgcccggtcttgcaggtattcttcccttttagcatccaactttacccatccgagttcccgggaagcgatcctcgggactgcccacgcgaccttaagaagaacgccgcgctcaagctgggttgcatcaatgcggagtaccccgactcgttcggtcactaccgggaagcgaagttcagtcagactaagcatcactggtggtggaaactgcacttcgtatgggagcgggtaaaggtgctgcaagactacaccggtctgatcctgtttctggaggaggaccactacctggccccggatttctaccacgtgttcaaaaagatgtggaagctgaaacagcaggagtgtcccggctgcgacgtcctgagtctggggacgtacacgacaatacgctctttctacggtatcgcagataaagtggatgttaagacttggaaatcaactgagcacaatatgggcctggcactcactcgggatgcttaccaaaagctcatcgagtgcacagatactttctgtacctacgatgactacaactgggactggactcttcagtacctgactctcgcatgcctgcctaaggtctggaaagtgctcgtgccgcaggcaccgcgaatttttcacgccggtgattgcggcatgcaccacaagaagacttgccgcccgagtacacaaagcgcgcagatagagtccctcctgaacaacaacaagcagtacctgttccccgagactctggtgattggggagaagtttcctatggccgccatctctccacctcgcaaaaacggtggatggggcgacatccgtgaccatgagctctgtaagtcgtaccggcgactccagtgagacgtgcacgcagtcctgtccccacccccgacagcaggagtgcgggactgggtgctctaacaagcgcatggtacgagctatgtgctggtgtgtagccagcggggctgtcatgccatgtcgatctctccccgtgagcagccccccaaaaagacaacctgatttctccctttttccgatatttctccctttgtgctaaggggatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 202 - DNA, 4268 bp, Artificial Sequence
  pLMTB9303
cggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacgcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgactagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctctgaggttacagtctcaggggggagtacgttcgcaagagtgaaacttaaagaaattgacggaatggcaccacaagacgtggagcgtgcggtttaatttgactcaacacggggaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 203 - DNA, 4166 bp, Artificial Sequence
  pLMTB9305
cagacgacggcgcagcggtggcagtgtggacgacaccagagagcgtcgaggcaggcgcggtgttcgcagagattggcccacgcatggcggagctgagcggcagccgcctggcagcacagcagcagatggagggcctgctggcaccgcaccgcccaaaggagccagcctggtttctggcgacagtgggcgtgtccccggaccaccagggcaagggcctgggcagcgcagtggtgctcccaggcgtcgaggctgcagagcgcgcaggcgtgccggcattcctggagacaagcgcgccacgcaacctgccgttctacgagcgcctgggcttcaccgtgacggcggacgtcgaggtgccagagggcccacgcacatggtgcatgacacgcaagccaggcgcgtagctagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctctgaggttacagtctcaggggggagtacgttcgcaagagtgaaacttaaagaaattgacggaatggcaccacaagacgtggagcgtgcggtttaatttgactcaacacggggaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 204 - DNA, 4674 bp, Artificial Sequence
  pLMTB9832
gggaaggataatgtgaacggacaacttctctgtcctttttcgttttaatttgtgattgtttcccgaagaagaaaagcaacaaaaccgaaaggggaaggagcgatgtgcgctcggcagaatagcctgtgcaaagttggcggcagcgcacgtgcgcacctggagatggcaacagcggcggcagtatgcacgcatgcacacacctggcagcgccagagatggaaagggacgaggatagagagggtaaagtgtcggaggagaacaagcacataaagggaggggcgaggtcgtgacggcgcgcgtgcttgttttgcccccccccctttcctgtggttttgctccgacctctctcttcctgtgtgttcccaccctctctctggatgcatatctgcgcgtgttttgcataggcacacacgcgacccgcgctgttgctgtccgctgccatcatgtcacctcccgccttttctctcctctgcacccgctgtgctcgacaatcgcagtggaaaaaaaggcgtgtgctccttttacatgcttcatgcccgacccctctccgtggcgtgtttacacttcaacgctacctcttgctcctcccccacccccgcctttgcgtgatctgccagagtcggcagtacaccaccctctcgctctcgtcctcccttgctgctcaacatccgcgcggagacacgcacccacacaggcacaccagacgccaagaaggtgagagggcgagtgagaatcagcaggggaaacctcttgccgcggtgtgcgtccgtctgtctgtctgctccttgcctctctcgacgattggcgtttgtttgctctcttagtgcatatacgatgctttacaggttttccaaatgttcgccaacctcaagtacgtgagccttggaatccttgtgtttcagacaacgagtctggtgcttacgatgcggtacagtcgcacattgaaggaagagggcccgcggtacctctcctccacagcggttgtcgtagcggagctccttaagatcatggcctgtatcttgctcgtttacaaggactccaagtgcagccttcgcgctctcaaccgcgtgctgcatgatgagatccttaataaacctatggagacgcttaagttggcgatcccatcaggcatctacacgctgcaaaataacctgctctacgtggcgctttcgaacttggacgccgctacctaccaggtcacctaccagctcaagatcttgacgacggccctgttttccgtgtctatgctctctaaaaagctcggtgtgtaccagtggctgtctctggttattctgatgacgggagtggcatttgtacagtggccttcggactcacagcttgacagcaaggagctctccgccggaagtcagtttgtgggcttgatggcggtgctgaccgcgtgcttttcctctggctttgcgggtgtgtactttgagaaaattctcaaggaaacgaagcagagtgtttggattcgcaacattcagctcggcttcttcggttctatttttggcctcatgggggtctacatctacgacggtgagctggtgagcaagaatgggttctttcagggatacaaccgtttgacgtggatcgttgtcgtgctgcaggctcttggtggccttgtgatcgctgccgtgattaagtacgcggacaacatcctcaaggggttcgcaacgtcattgtccataatcctctctacactgatctcatacttttggctccaagacttcgtgccgacgtcagttttcttcctcggagcaattctggtgatcacagccacctttttgtatgggtacgaccctaagcccgccggtaacccgacgaaggcctgagcttcatgtacaatcatcgcgcacctttctttttcattgattagggccaactccccaccgatgtaaaaaaaatcctgaaagtgggatgacacaattcagtgacaatggaaaaaaaagaagcgtgattggtattcaagcttcacacacgtatttccccccatacacaaggatgtgttattgttttctacttgattcgggtaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 205 - DNA, 3962 bp, Artificial Sequence
  pLMTB9833
gctccggccccttccgggtccagtattcctcccgggactccttcaaggtcctggcccggaacctgggcgtcatggacgacctgaagtccggcgtcccccgggccggctatcggggcgtcgtctccttcatctcccggggccggcggatctatctggccccccccgagggctggaccaagtatgacgtctcctggtcctaatgccccgccgccgttgccgccacaccgccgtggccaataccaaagcgtgcatatttcgggcgcgtctgcatttttagtcccccttcttaggccttgtattgttcacttcatcttcccttctgtaggacgtctctctgttccatttcttttcttgtatgcgccccctcactaccgcctcccacgctctctctctctcgctctgtgtgtatgtgtgtgtgtgtgtgtgcacactttcgcgtcttcgacttgtccctttgtttttctcactctctctgccccctccccacctcaccgcctgtctatgcgcttccctccctgttgttctgtatgcgtaggtgtatacgtggtacacctcgagtgccacggcgtggcgcacatagcagcgttttcgttttttcgcttggtagaagatgcgcaaacggcgttcacgaccactgaaacagcgcgacatcggcgcgcacgcagtcccctttgccaatagcgaaatccggcacccgcacgtcagttctggctctctttcctcctcttcccatgacccgatggtggagctgcaaccagcttctcttttcgccttctgggaggcgggggtcatgcctactccctcagtcttcatgctttatccttcattgcctacccctttgtttgctgccgtctacctcactttcttccgacacacacacacacacacatacacacacacatacacacacacatacacacacacatacacgtgccgttcatctcttcttgcacctcacaatctgcgccttcttctttcagctgttcactgaactagaagcatctggcgaataccctcccccctcaacatacacaccgtaccacccccttctctccccctccacctccaaaaaaaaaatatatatttctcctctgtgccttcgcccatctcatcatttatcatgcgcttccgcatctacaagcgaaaggtggtgatactcacgctcgtcgtgataatttgcggcttcgccgtgtggaactccggcaaaccgaagaaggctagcacggtgtttccaaaggaagtggaaactgtgaagcgctcgagcgtggggtctcaaatccaggccacaatcccggtgacacgcaagccgatcaatgagtcatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 206 - DNA, 3581 bp, Artificial Sequence
  pLMTB9834
atgcatgcccagcggtcaaaaaacgaaaatcgagaacgtacttcagaactcgggcaaccagctgtttccaaagcaacttctgatcaccaagcgcttgccagcgtccggggcgaagggcgtcgctcctcatgttaaaaacggtggttggggcgacatccgggaccacgaactgtgtaagtcgtacctccggctccagtgactgcgttacgcgcacactcgcatgggatagaggagaggagtgtttcgaatgtaaatagtttctccccaggaatgtgtctaagcgcgaacaaataatacgaacagtgaacacgccgcagccttgctgtgcattcagactgcctttgacaaagagacatacgcatagccacgcaaagatgccgttgacccaccgtcttgctctcgtgttgcgcaacatgtccttccgtcattttttcacctgtgtccatgtcaacttcccttcctaccattgatgccgagtcatcatctccgcggctttggttatgcgcacttttccgaaacgccggctactctcagcttttccctccgcttttcacctctattgacttacataccctaagctgcaggtgctgaagcttcccagcttgtggttgcaaaagtagcagctgctggttcaaacacgcatctacgaaagcaaatagaaaaaaacgccggaaactccgtgcacacgcaaacacgcgtacgggcacagcgcagacaaggaacacggaacaacatcacaatgctcaagaagagcagcctcgttctttggggagttgtattgtttgtggcatggaatgctctgatactgtttttcctgtggacgcgtcctcagagcctgtccgaccactcgcacctgaccgaggaggtgatccgcttggcccaggatgcggaatcggagctggagcgtcagaaggatctgcttcagcagatctaccgataatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 207 - DNA, 3735 bp, Artificial Sequence
  pLMTB9835
gctcggaacggtgcgagtgcaatacacgactcgagactccttcaaggcattcgcgaaggctctgggcgtaatggatgacttgaagtccggcgtcccacgtgccggttatcgcggcatcgtcagttttctttaccagagccgacgtgtgtacctggcacccccgagcgactggactggctacgacccgtcctggagttgatggccactgcctggaagtaggccacacaaatgcacaggcattcattagtgagcgtgcaagagcagacgaccgccttcaacagcgcttcgccctcacgcatgcagaagcgttgctttttttgtctactcagcttccttcttcccagctcactcggtcgcgttggctggggtcttcaaagaagagggccaaacaccaaacaagaacgagccagcgccactcagctacgggctaaagcacatgcggacacgctcacaggcgcgttcgctgcgcagaagcacagctgagctgcaaagatatagatgcgcccccgcgaggcggcagtgagagcggttctccttcattgactgacacgtgaagctggccccatccacccctgcccacgcagcccgtcgaaagggggacaccggcgcatgatagggtaaggcgagcgtgcgtgtgtatgtgcgtctgatcgctccctcacgggctcatgctgcatcttcctcggcgtcctctgcacgcccgctctctgcgtctcactctcttccacctgatgtatttacctctccgtatctctccgtgttcatttctacgttctcgccttcgcgcccaacgtcacacctgctgtcttttgtttcttgcacacacgcggcgtcccttccgcactacccacagtcccagcgctttccactcaccccaccacctcacctctacaatgcgcccacggaaaacaatactgcttgtgggagtgctggtaatctgggtgcttatgacctaccttgccttcatgcgcagtgtgcgcggtacagacggctctcgacctcggccagcattcgcttcaaacaagctcatgttggagaaagtccaggactttgagcagaaccttaagtcatttgcggacagccgccaaaacctatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 208 - DNA, 4243 bp, Artificial Sequence
  pLMTB9836
atgcgcccacggaaaacaatactgcttgtgggagtgctggtaatctgggtgcttatgacctaccttgccttcatgcgcagtgtgcgcggtacagacggctctcgacctcggccagcattcgcttcaaacaagctcatgttggagaaagtccaggactttgagcagaaccttaagtcatttgcggacagccgccaaaacctttaccgggacattatcaacatcctgcgccggaccgacaaggtgtcaagcgtgccagcacagccaattccggcggtgccatcccaggaaagcccaggggctgcggtgcaggagtctgaggtgccgaaggagcgtcaggcgcccccgcagcgctaccttaacaacgacccggcgtttcctgtcatcccagtggtggtctttgcatgcaaccggatcagcgtcaacaagtgcctcgatgatctgatccggtaccgcccgagtgcagagcagtttccaatcatcgtctcccaggattgtgacgacgaggccacccggaacaccatcctcagctatcgtgacgaggtcacactgatccagcaacccgatcagtccgacatcccggttcctcccaaggagaagaagtacaagggttactacaaaataagccgccattacgggtgggctcttcgcgctgtgttcggacagggctttgactctgttatcctggttgaggacgacctgagcgtcgcacccgacttctacgagtactttctggggacctaccccatattgaaacgcgataagtccctttggtgcgtaagtgcctggaatgataacggtaaagagggactcatcgacacaaccgcgcacgatttgttgtatcgcagcgacttctttccgggccttgggtggatgatgacgaaggacctgtgggacgagttggagcctaagtggcccaaggccttttgggatgactggattcgccagccggagcaacgtaaggaacgggcgtgtatccgtcctgagctgccccgtacgcgtacatttggtaagatcggggtgtctaacggacttttttttgataagcacctgaagttcattaagcttagcgaagagttcgtgtcctttacgaagacgaacctcagctacctggtcaaaagcgcgtacgacgacgcattcctgaaaaccgtctaccagtcgccagtcgtgacgctggacgaactgaagcgcggcatggttatgacacgtgaacccatccgcatcgcgtaccatacgaaggagcagtacaaacgcgcgacaaagaaccttggtctgatggacgatttcaagtctggtgtccctcgtacagcctatcgcggggttgtgtccttcttctacaacggccagcgcgtgtatctcgcgccttctgctaactggaagggctacgatctgacatggtcctaggggaaggataatgtgaacggacaacttctctgtcctttttcgttttaatttgtgattgtttcccgaagaagaaaagcaacaaaaccgaaaggggaaggagcgatgtgcgctcggcagaatagcctgtgcaaagttggcggcagcgcacgtgcgcacctggagatggcaacagcggcggcagtatgcacgcatgcacacacatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 209 - DNA, 3703 bp, Artificial Sequence
  pLMTB9838
gcttcatgtacaatcatcgcgcacctttctttttcattgattagggccaactccccaccgatgtaaaaaaaatcctgaaagtgggatgacacaattcagtgacaatggaaaaaaaagaagcgtgattggtattcaagcttcacacacgtatttccccccatacacaaggatgtgttattgttttctacttgattcgggtacgctcaccacagcgcacctcgtctgaaaagcacttgatactgttccttctttcgcgtatgttcatctatgaaagagcaacattattcggccacctgtttcgcgtgggcacacgcacactagggctatgatgttttgcttcatcggcaatctgtgctctgctgaggcagccgctgttttgcttggtgctctttttccctcttctttggtgcaatgcattccgcttgtcgcagcaaccattctcccactctgtttctttcaactgtcgtcgcttctattccctcgatcttttatctggatgcatgacaatatgcagaacaaaagcaagaccagtgagtttggtttcgtttccacctgaaaaatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggttgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggcatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 210 - DNA, 4014 bp, Artificial Sequence
  pLMTB9839
gctccggccccttccgggtccagtattcctcccgggactccttcaaggtcctggcccggaacctgggcgtcatggacgacctgaagtccggcgtcccccgggccggctatcggggcgtcgtctccttcatctcccggggccggcggatctatctggccccccccgagggctggaccaagtatgacgtctcctggtcctaagcccacaccctccctcctctctgtctctcttagatctctttcaaaggtcgtggtggagatgaacatctcggctcatctcctcccggagagggagaagcactgggcctctgcacgcggcagcggcacgcacacgcgcacatgtctgcgtgtgtaaggggcgtggcaggcagcgtgtgtgcctccacgctgccgcgcacgccgtatcatagatgcacttctgttttttattattttaaatgcgccatgcaaaggggggaggggaatatgttctgcgtaatgtgcgcgcactcgatctctgtgacccggcgatggcgtgcgtgagagagggccgtgcgtgggtgcgatggacggcgtcgtcctcgcactccgtgctggccggcagctgaggagagagcgcagaggacgcaaaggtagcgagcaaggagcggcacgcccacgcagtgcgcgcgcgtataggtggatgcctctctgcgcgatgcgtgcgtgtgcctgtgccgcgcaagtaacgaatgacgcgccagcggtgctgctgccgctgctttccgcccacctcatcgaagcggccccgtcgtcggcacacagggacgtctgcgctgccggccctgcgctgatccgcttgtacgtgcggcgcttcagccctctacgcagcagcggggtgggaggggggtcaaagcatacctgaccccaacctcctttataaccgctcaacagcaacctcaggatgacgcggcagatgtgcgcgccgctggtctccttcactttcgcgccccctgccccaactcacccacccacccccccctcctcctctcctccgccttcccgttaacattcggatgcgcgcatgtgcgcagtgcatcctcagcgcagtccacaccgccatcgttctccccgccacgccccttccacccagaccagagaaagagccgtagccacgtaggccaccgcacccgagcacgaccatcgcgtgtcaccatgcgcttccgcatctacaagcgaaaggtggtgatactcacgctcgtcgtgataatttgcggcttcgccgtgtggaactccggcaaaccgaagaaggctagcacggtgtttccaaaggaagtggaaactgtgaagcgctcgagcgtggggtctcaaatccaggccacaatcccggtgacacgcaagccgatcaatgagtcatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 211 - DNA, 3805 bp, Artificial Sequence
  pLMTB9840
atgcatgcccagcggtcaaaaaacgaaaatcgagaacgtacttcagaactcgggcaaccagctgtttccaaagcaacttctgatcaccaagcgcttgccagcgtccggggcgaagggcgtcgctcctcatgttaaaaacggtggttggggcgacatccgggaccacgaactgtgtaagtcgtacctccggctccagtgagctcttcggatcgcagcgagagagtgtacgcacgtgcgtgcgggtgtgtcgcgggcttcgccctttacttttagtttgtgtgcatcgcttcttcattttttaatggcccgcttcgaacgaaagcgaaacaagacgagatggcgtcacgacgagagacagacggacggacagagagaaggaccgcggagggaaggcacagatgtagccgcacctcgaatcgccattcctttcgagccttcatctcgcgctctctcgcctatcatgagcggcgtcaatgcacttgccgcctatttgtcagtgccgtgcctgacgtctgtgtgtgtgtgtgtaccacactcgtcttccgtgtgctcgacagcgggtgaggttgggtaagggcccgatttggtagtatcaggcaatgtccacgttgctcggcaacgtagggccgagataggatatggtagaaacggcatgttgcttgaaggaggtgctctccgccctcccctgcccccgcttccagtcccgactccgctcagtcactgcaccgcaactctcgcatcattgacgcaaacatctcacttccctcggtctcggtctcttttcttgctaacgcacttctgcgtggcgcatcacgcacgcattcatcttcgcacgcgtggccgcgtgtgtatttgtgtgttcgcgcgtcgccccccccctccgcccatctccctaccggtgtcttactgctcctgtgaaagcatacgtatccacgcccctctgtgtgtgtgtctgtgatcgcaatgctcaagaagagcagcctcgttctttggggagttgtattgtttgtggcatggaatgctctgatactgtttttcctgtggacgcgtcctcagagcctgtccgaccactcgcacctgaccgaggaggtgatccgcttggcccaggatgcggaatcggagctggagcgtcagaaggatctgcttcagcagatctaccgataatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 212 - DNA, 3600 bp, Artificial Sequence
  pLMTB9841
gctcggaacggtgcgagtgcaatacacgactcgagactccttcaaggcattcgcgaaggctctgggcgtaatggatgacttgaagtccggcgtcccacgtgccggttatcgcggcatcgtcagttttctttaccagagccgacgtgtgtacctggcacccccgagcgactggactggctacgacccgtcctggagttgaggcacgcagtgtgtgtctcgtttgctccgaattctttttcctttttcgtttttcgtgtttcgcgtgcctctcttttcggcgcatgcgaaaaacagcacagcaatccagcaaacgaacaaagaaaatcatcgatggcgcacgctacgccaaggttgggggtggagcgggggtggcggcaacgccgtgtgcagcagagcagacacccatcgcagaagcccccggtatctgcgtgcatgtgtgttcggtgcacgaccgggtcgtgctgcttgtatgtttggggagggaggggctgcgttgccttcctcacgcctcccatccctccatccctgtcgccttctaggggtcgccgaggcgcgtgcagagacggactctacaggcccaggcgagatggcaacgggcgcacgcacacacgcacgcggagggaggaatgtttgggatgaatcacactgcactgaaacctctcttctaccctcatcagccttcatcttcactcgacacacagacgcgccgctgtcgccaccgcctcagaaaaggcagcaagcacacgtgaaaccctaaaatgcgcccacggaaaacaatactgcttgtgggagtgctggtaatctgggtgcttatgacctaccttgccttcatgcgcagtgtgcgcggtacagacggctctcgacctcggccagcattcgcttcaaacaagctcatgttggagaaagtccaggactttgagcagaaccttaagtcatttgcggacagccgccaaaacctatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 213 - DNA, 3836 bp, Artificial Sequence
  pLMTB9852
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatcctgcaggtgaaatggtgtatcccatgacacgtcttacgtcatgttcctccctccttcgtatgcgtacgactctcctccgcctccgcctccgcctccgcctccgcctccgcctccgccttctctgcgccggtttcctggaggatggagagctcttgctcatagattgaagaaagaccaggcaagccacggaaaactccgaacaaaagcggactcacgcggccgtctgcatttgacgtgcttgcatacatatacgcaccaaccttgtgcacgtcttgttgacatccgtaacacttgcctcattttttccgtgctgctcggatgcacactcctggtgtggggcgtagtcactattcgtctctcaccaacacacacacacacacacacacacacctgtacatctctctctctctccttttctgtgtgccccggcggacgtgcgtgcgtgtctaatcactgaaattcttcacattgcatagaacgtagcgtcaggacgcagcctcgaacggcgatgaagccagaactcgagagtatggccaagttgaccagtgccgttccggtgctcaccgcgcgcgacgtcgccggagcggtcgagttctggaccgaccggctcgggttctcccgggacttcgtggaggacgacttcgccggtgtggtccgggacaacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggacgtcgagtccggaatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttttcgaaatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 214 - DNA, 3834 bp, Artificial Sequence
  pLMTB9853
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatttaattaagcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagactatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtagcctcggagatccatggggtgtgctttccaggccgctgagcggagaggtgcggagggcagtccaggaaggtggggagggaggagggatggtacccaagcgagaaggggacggacgagctcaaggctgaaagtttcagccaacggtttccggcgctgcatccgttctcatgttttggcactcgtcatatgcttttatttctgtaatcgtttttggaggagggaggaggggaggagatgtgggcgagcagagacggcggcagcagcaaaaaaaagggggggcgcccaccggcgctggtgaggcgtgcagggggaagagggtggcatgcgacatgcacaaccaaacgtgcgcgtgtgcagatgtgctggcgtgcgtcgtgagtgtgtgatttatttttgaatgacaccttatcattgctctctctgcctcacactctctcgcttccaccgctttaccttgctacgagtgtcgcttcggtataccgtcactgacgttgcctctcccctctccatactttcgcctgcaggatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 215 - DNA, 2642 bp, Artificial Sequence
  pLMTB9854
atttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 216 - DNA, 3834 bp, Artificial Sequence
  pLMTB9855
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatttaattaagcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagactatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtagcctcggagatccatggagggagaatgatgatgtgaccgaggtggcgcgctcgcacgtgtcctcctcctccccctcctcctcctcttcttcttcctcctcatggccgccctctgcggtggtcctctctcaccttttcatgtgttcctgtgtggcgtgcgtgtcgctcaggggattcccgtgtgtgtgtgggggggggggatgccggccactggggcgtggggcgtgcgggcgcggcagcaggctctcgaggtgatggctggttggactcttggcgtggggggcggtgcgggtgtccgttggttgaccggcccgtagtggagcacgggcacaagtggacaccggcaggaacgttcctgctggtcactgtttcgatactgctttcctcgtcaccctgtgcgtcgctctctgtgcccctctcctcccctctctgtctctgtctctctctctgtgtgagtatgtgtgtataggtgggggggggagagagaagctgtgcgtgtgcacggtggtattgtgtggcctgcaggatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 217 - DNA, 3774 bp, Artificial Sequence
  pLMTB9856
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatcctgcaggtgaaatggtgtatcccatgacacgtcttacgtcatgttcctccctccttcgtatgcgtacgactctcctccgcctccgcctccgcctccgcctccgcctccgcctccgccttctctgcgccggtttcctggaggatggagagctcttgctcatagattgaagaaagaccaggcaagccacggaaaactccgaacaaaagcggactcacgcggccgtctgcatttgacgtgcttgcatacatatacgcaccaaccttgtgcacgtcttgttgacatccgtaacacttgcctcattttttccgtgctgctcggatgcacactcctggtgtggggcgtagtcactattcgtctctcaccaacacacacacacacacacacacacacctgtacatctctctctctctccttttctgtgtgccccggcggacgtgcgtgcgtgtctaatcactgaaattcttcacattgcatagaacgtagcgtcaggacgcagcctcgaacggcgatgaagccagaactcgagagtatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgttcgaaatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 218 - DNA, 3896 bp, Artificial Sequence
  pLMTB9857
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggtaccatttaaatttaattaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagcctcggagatccatggggtgtgctttccaggccgctgagcggagaggtgcggagggcagtccaggaaggtggggagggaggagggatggtacccaagcgagaaggggacggacgagctcaaggctgaaagtttcagccaacggtttccggcgctgcatccgttctcatgttttggcactcgtcatatgcttttatttctgtaatcgtttttggaggagggaggaggggaggagatgtgggcgagcagagacggcggcagcagcaaaaaaaagggggggcgcccaccggcgctggtgaggcgtgcagggggaagagggtggcatgcgacatgcacaaccaaacgtgcgcgtgtgcagatgtgctggcgtgcgtcgtgagtgtgtgatttatttttgaatgacaccttatcattgctctctctgcctcacactctctcgcttccaccgctttaccttgctacgagtgtcgcttcggtataccgtcactgacgttgcctctcccctctccatactttcgcctgcaggatttaaatggtaccatcccaatggcgcgccgagcttggtcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 219 - DNA, 4717 bp, Artificial Sequence
  pLMTB10054
ggcgtgtgcgcaccggcgtgtgccaacgcccaggtactgtgcgcacgttcgtatctccatacgctagctgaccgagacgcatgccctccgccaccctcagtggcgcgcaccttctctcgtttgagctctttatgctctcgtgaatggcacacaacatcccgtgactatcacgatgatccttctcaagccacaccgcttgccttttctacagctctgcgttctctggcccatcctcctcttgtttgctttccctctttgcacatccgtgtgcgcgtccttgttcttctcttctgcgcacactattctgcgcccgcgacccgcgcttcgactgctgtcgggtcatgccttgtgctgcgcgttcagctcttcattgcccctcggccttgtacatagcggctctccgtcatcgacgttttcctctctcttcagctctatacactccctcccttgtcaacacactacactgtgtctccccctttcatctctcctcccctgtcacaatggtccggaagaagggctccctgatcctgtgcggcgccttcctgttcgtcgcctggaacgccctgctgctgctgttcctgtggggccggccccccatcggccggctgggcgagggcggcggcgccgagcccggcgccggcgaggagtggggcgccggcaagtccaaggtcggcggcgccaacggcctggccggcgaggtcatccggctggccgaggaggtcgagtccgagctggagacccagaagaagctgctgaagcagatccagtcccaccgggagctgtgggagcagcggaaggagctggagaagcgggagtccgaggacaccaaggacgagaagatcgacgtcgagcccaagaagccccggcagatccccgccgtccacctgtcccacaaggtcgtcgaggacgcccagaccgtcaccaagaagatgcagaccctgatggtcacccccccccagctggtcatgaaggagcaggagaccgaccagaagaacaagcagatgatggaggaccagctgggcctgaccaccccctccccccagatcatcatccccatcctggtcatcgcctgcgaccgggtcaccgtcaagcggtccctggaccggctgatccagtatcggccctccgccgagctgtatcccatcatcgtctcccaggactgcggccacgccgacaccgcccgggtcatcggctcctatggctcccagatcacccacatctcccagcccgacctggccgacatccccgtccggcccgaccaccggaagttccagggctattataagatcgcccggcactatcggtgggccctgaaccaggtcttcaacgtcttcgcctattccaccgtcgtcatcgtcgaggacgacctggaggtcgcccccgacttcttcgagtatttccgggccctgtatcccatcctgcggtccgaccccaccctgtggtgcatctccgcctggaacgacaacggccgggacggcctggtcgaccccggcaaggccgagctgctgtatcggaccgacttcttccccggcctgggctggatgctgctgaaggaggtctgggccgagctggagcccaagtggcccaaggccttctgggacgactggatgcggcaccccgagcagcggaagaaccggtcctgcatccggcccgaaatttctcggaccatcaccttcggccggaagggcgtctccctgggccagttcttcgaccagtatctgcggtatatcaagctgaacaccgagttcgtccccttcaccaagcacgacctgtcctatctggtccgggagaagtatgacgtctccttcgagaaggacgtctattccgcccccctggtcaaggtcgaggagctgcagcacggcggctccctgaagggctccggccccttccgggtccagtattcctcccgggactccttcaaggtcctggcccggaacctgggcgtcatggacgacctgaagtccggcgtcccccgggccggctatcggggcgtcgtctccttcatctcccggggccggcggatctatctggccccccccgagggctggaccaagtatgacgtctcctggtcctaaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 220 - DNA, 4398 bp, Artificial Sequence
  pLMTB10055
gcttcatgtacaatcatcgcgcacctttctttttcattgattagggccaactccccaccgatgtaaaaaaaatcctgaaagtgggatgacacaattcagtgacaatggaaaaaaaagaagcgtgattggtattcaagcttcacacacgtatttccccccatacacaaggatgtgttattgttttctacttgattcgggtacgctcaccacagcgcacctcgtctgaaaagcacttgatactgttccttctttcgcgtatgttcatctatgaaagagcaacattattcggccacctgtttcgcgtgggcacacgcacactagggctatgatgttttgcttcatcggcaatctgtgctctgctgaggcagccgctgttttgcttggtgctctttttccctcttctttggtgcaatgcattccgcttgtcgcagcaaccattctcccactctgtttctttcaactgtcgtcgcttctattccctcgatcttttatctggatgcatgacaatatgcagaacaaaagcaagaccagtgagtttggtttcgtttccacctgaaaaatgcgcctccgcgaacccctcctgagcggctccgcagcgatgcctggggcttcgctgcagcgcgcctgtcggctgctcgtagcggtctgcgcactccaccttggcgtgactctcgtctactatctggcgggacgagatctgtcgcgcctcccacagctcgtgggtgtgtcgacgccgctgcaaggaggctcaaattcggccgcggccatcggtcagagctccggcgagctgcgcacgggaggagcacgcccgccacctccgctgggtgcatcgtctcagccccgtccgggcggcgacagttcaccggttgtggactcgggtccaggacctgcatctaaccttacgtccgtgcccgtaccacacacgacggctctttcgcttccagcctgtcccgaagagtcccctctgcttgttggtccgatgttgatcgagttcaacatgcctgttgatctcgaattggtggcaaaacaaaacccaaacgtgaaaatgggaggccggtacgccccgcgagattgcgtgtcgcctcacaaggttgcgatcatcatcccctttcggaatcgccaggaacaccttaagtactggttgtactacctccaccccgttttgcagcgccagcagttggattatggcatctacgtcattaaccaggccggtgatacgatttttaaccgcgccaagctgctcaacgtgggttttcaggaggcgctcaaggactacgattacacgtgcttcgtcttttccgacgttgatttgattcctatgaacgaccacaatgcgtatcggtgtttcagccagccgcgccacatttcggtagccatggataagtttggattctccctgccttacgtacaatacttcggcggcgtgagcgcattgtcgaagcaacagttcctgacgatcaacggctttccaaacaattactggggttggggcggggaagacgacgacatcttcaatcgtctggtgtttcgtgggatgtctatttcccgcccgaacgcagtcgtcggtcgctgccgtatgatccgacattctcgtgataagaagaacgagcctaacccacagcgcttcgaccgaatcgctcatactaaggaaacgatgctctccgacgggctcaactctctcacataccaggtcctcgacgtgcagcgctatccactttacacgcagattacggtcgacatcggcaccccgtcgtgaatttaaatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaat

SEQ ID NO: 221 - DNA, 25 bp, Artificial Sequence
  oLMTB7173
cgcacctcggcttcaactgccaatg

SEQ ID NO: 222 - DNA, 25 bp, Artificial Sequence
  oLMTB 7174
aacgtgcctgaagcccgtagctttg

SEQ ID NO: 223 - DNA, 25 bp, Artificial Sequence
  oLMTB 7175
ggcgacggatgatgcccaccatttg

SEQ ID NO: 224 - DNA, 25 bp, Artificial Sequence
  oLMTB 7176
ggaggcaaccaagaaggcgtcagag

SEQ ID NO: 225 - DNA, 25 bp, Artificial Sequence
  oLMTB 7492
ccatggccagatgccaagcttactc

SEQ ID NO: 226 - DNA, 25 bp, Artificial Sequence
  oLMTB 7495
cggaacacagacctgccatctgtgg

SEQ ID NO: 227 - protein, 26 aa, Artificial Sequence
  tryptic peptide from Adalimumab carrying the O-HexNAc on Thr225
THTCPPCPAPELLGGPSVFLFPPKPK

SEQ ID NO: 228 - protein, 9 aa, Artificial Sequence
  tryptic peptide from Adalimumab carrying the N-glycan Man3
EEQYNSTYR

SEQ ID NO: 229 - protein, 10 aa, Artificial Sequence
  tryptic peptide from CD43 carrying three GalNAc
YTTSITSDPK

SEQ ID NO: 230 - protein, 14 aa, Artificial Sequence
  14 aa peptide produced by double digestion of Adalimumab with FabRICATOR (IdeS) and GingisKHAN (Kgp)
THTCPPCPAPELLG

SEQ ID NO: 231 - DNA, 23 bp, Artificial Sequence
  gRNA_OGNT-1_3
gttcttcgcgaaatccgatgcgg

SEQ ID NO: 232 - DNA, 23 bp, Artificial Sequence
  gRNA_OGNT-1_5
acacgcatgcgggtgaggtgagg

SEQ ID NO: 233 - DNA, 23 bp, Artificial Sequence
  gRNA_OGNT-2_5
agtggttcacaaccgaatcccgg

SEQ ID NO: 234 - DNA, 23 bp, Artificial Sequence
  gRNA_OGNT-2_3
gatgggcacggaacggcctgtgg

SEQ ID NO: 235 - DNA, 23 bp, Artificial Sequence
  gRNA_OGNT-L_5
acggtgacgcgaactcgcagagg

SEQ ID NO: 236 - DNA, 23 bp, Artificial Sequence
  gRNA_OGNT-L_3
cttgtctcggtggcgccaagcgg

SEQ ID NO: 237 - protein, 15 aa, Artificial Sequence
  tryptic O-glycopeptide position [117-131] of LMSAP-rhEPO-Strep
EAISPPDAASAAPLR

SEQ ID NO: 238 - protein, 30 aa, Artificial Sequence
  Adalimumab peptide that likely has O-glycosylation
LTVDKSRWQQGNVFSCSVMHEALHNHYTQK

SEQ ID NO: 239 - protein, 30 aa, Artificial Sequence
  tryptic peptide with one missed cleavage and the HexNAc
SCDKTHTCPPCPAPELLGGPSVFLFPPKPK

What is claimed:

1. A *Leishmania* cell genetically engineered such that the formation of an O-linked N-acetylglucosamine (GlcNAc) on a polypeptide in the *Leishmania* cell is reduced or eliminated, wherein a gene encoding at least one O-linked GlcNAc-transferase of the *Leishmania* cell is functionally inactivated, downregulated, deleted, mutated, or overexpressed.

2. The *Leishmania* cell of claim 1, wherein the formation of O-linked GlcNAc in the *Leishmania* cell prior to genetic engineering is catalyzed by the at least one O-linked GlcNAc-transferase.

3. The *Leishmania* cell of claim 1, wherein the formation of the O-linked GlcNAc is reduced by at least 5%, at least 7%, at least 10%, at least 12%, at least 15%, at least 18%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or 100% from the formation of the O-linked GlcNAc in a reference *Leishmania* cell.

4. The *Leishmania* cell of claim 1, wherein the at least one O-linked GlcNAc-transferase is selected from the group consisting of OGNT1, OGNT2 and OGNTL, and homologous GlcNAc-transferases thereof.

5. The *Leishmania* cell of claim 4, wherein the at least one O-linked GlcNAc-transferase is a GlcNAc-transferase that is homologous to OGNT1, OGNT2 and/or OGNTL.

6. The *Leishmania* cell of claim 1, wherein the number of the at least one O-linked GlcNAc-transferase is one, two or three.

7. The *Leishmania* cell of claim 1, wherein the growth rate of the *Leishmania* cell is at least 60%, at least 65%, at least 70%, at least 75%, at least 80%, at least 85%, at least 90%, at least 95%, or 100% of the growth rate of a reference *Leishmania* cell.

8. The *Leishmania* cell of claim 1, wherein the *Leishmania* cell is *Leishmania tarentolae.*

9. The *Leishmania* cell of claim 1, wherein the polypeptide is selected from the group consisting of adalimumab, rituximab, and erythropoietin (EPO).

10. The *Leishmania* cell of claim 1, wherein the *Leishmania* cell comprises a recombinant nucleic acid encoding a heterologous glycosyltransferase.

11. The *Leishmania* cell of claim 10, wherein the *Leishmania* cell comprises one or more heterologous glycosyltransferases.

12. The *Leishmania* cell of claim 10, wherein the heterologous glycosyltranferase is an N-acetyl glucosamine transferase; and/or a heterologous galactosyltransferase; and/or a heterologous sialyltransferase.

13. A method of making a polypeptide comprising (a) culturing the *Leishmania* cell of claim 1 under suitable conditions for polypeptide production; and (b) isolating the polypeptide.

14. The *Leishmania* cell of claim 2, wherein the gene encoding at least one O-linked GlcNAc-transferase of the *Leishmania* cell is functionally inactivated, downregulated, deleted, or mutated.

15. The *Leishmania* cell of claim 14, wherein the at least one O-linked GlcNAc-transferase is selected from the group consisting of OGNT1, OGNT2 and OGNTL.

16. The *Leishmania* cell of claim 14, wherein the at least one O-linked GlcNAc-transferase is a GlcNAc-transferase that is homologous to OGNT1, OGNT2 and/or OGNTL.

17. The *Leishmania* cell of claim 15, wherein the at least one O-linked GlcNAc-transferase is one O-linked GlcNAc-transferase selected from the group consisting of OGNT1, OGNT2 and OGNTL.

18. The *Leishmania* cell of claim 15, wherein the at least one O-linked GlcNAc-transferase is two O-linked GlcNAc-transferases selected from the group consisting of OGNT1, OGNT2 and OGNTL.

19. The *Leishmania* cell of claim 15, wherein the at least one O-linked GlcNAc-transferase is three O-linked GlcNAc-transferases selected from the group consisting of OGNT1, OGNT2 and OGNTL.

20. The *Leishmania* cell of claim 15, wherein the at least one O-linked GlcNAc-transferase is two or three O-linked GlcNAc-transferases, each of which independently is homologous to OGNT1, OGNT2or OGNTL.

* * * * *